(12) United States Patent
Cojocaru et al.

(10) Patent No.: US 7,553,948 B2
(45) Date of Patent: Jun. 30, 2009

(54) NUCLEOTIDE AND AMINO ACID SEQUENCES, AND ASSAYS AND METHODS OF USE THEREOF FOR DIAGNOSIS OF OVARIAN CANCER

(75) Inventors: Gad S. Cojocaru, Ramat-HaSharon (IL); Sarah Pollock, Tel-Aviv (IL); Zurit Levine, Herzlia (IL); Alexander Diber, Rishon-LeZion (IL); Guy Kol, Givat Shmuel (IL); Amir Toporik, Azur (IL); Rotem Sorek, Rechovot (IL); Dvir Dahary, Tel-Aviv (IL); Michal Ayalon-Soffer, Ramat-HaSharon (IL); Pinchas Akiva, Ramat-Gan (IL); Amit Novik, Beit-HaSharon (IL); Yossi Cohen, Banstead (GB); Osnat Sella-Tavor, Kfar Kish (IL); Shira Walach, Hod-HaSahron (IL); Shirley Sameah-Greenwald, Kfar Saba (IL); Ronen Shemesh, Modlin (IL); Maxim Shklar, Tel-Aviv (IL)

(73) Assignee: Compugen Ltd, Tel Aviv (IL)

( * ) Notice: Subject to any disclaimer, the term of this patent is extended or adjusted under 35 U.S.C. 154(b) by 37 days.

(21) Appl. No.: 11/714,282

(22) Filed: Mar. 6, 2007

(65) Prior Publication Data

US 2009/0004648 A1  Jan. 1, 2009

Related U.S. Application Data

(63) Continuation of application No. 11/050,857, filed on Jan. 27, 2005, now abandoned.

(60) Provisional application No. 60/620,916, filed on Oct. 22, 2004, provisional application No. 60/628,123, filed on Nov. 17, 2004, provisional application No. 60/621,131, filed on Oct. 25, 2004, provisional application No. 60/620,917, filed on Oct. 22, 2004, provisional application No. 60/628,101, filed on Nov. 17, 2004, provisional application No. 60/620,874, filed on Oct. 22, 2004, provisional application No. 60/628,134, filed on Nov. 17, 2004, provisional application No. 60/620,924, filed on Oct. 22, 2004, provisional application No. 60/628,111, filed on Nov. 17, 2004, provisional application No. 60/620,853, filed on Oct. 22, 2004, provisional application No. 60/628,112, filed on Nov. 17, 2004, provisional application No. 60/620,974, filed on Oct. 22, 2004, provisional application No. 60/628,145, filed on Nov. 17, 2004, provisional application No. 60/620,656, filed on Oct. 22, 2004, provisional application No. 60/628,251, filed on Nov. 17, 2004, provisional application No. 60/620,975, filed on Oct. 22, 2004, provisional application No. 60/628,178, filed on Nov. 17, 2004, provisional application No. 60/622,320, filed on Oct. 27, 2004, provisional application No. 60/628,190, filed on Nov. 17, 2004, provisional application No. 60/630,559, filed on Nov. 26, 2004, provisional application No. 60/628,231, filed on Nov. 17, 2004, provisional application No. 60/620,918, filed on Oct. 22, 2004, provisional application No. 60/628,156, filed on Nov. 17, 2004, provisional application No. 60/620,677, filed on Oct. 22, 2004, provisional application No. 60/628,167, filed on Nov. 17, 2004, provisional application No. 60/621,004, filed on Oct. 22, 2004, provisional application No. 60/622,017, filed on Oct. 27, 2004, provisional application No. 60/539,129, filed on Jan. 27, 2004, provisional application No. 60/539,128, filed on Jan. 27, 2004, provisional application No. 60/628,179, filed on Nov. 17, 2004.

(51) Int. Cl.
  *C07H 21/02* (2006.01)
  *C07H 21/04* (2006.01)
(52) U.S. Cl. .................................. 536/23.1; 536/24.33
(58) Field of Classification Search ................ 536/23.1, 536/24.33
  See application file for complete search history.

(56) References Cited

U.S. PATENT DOCUMENTS

2004/0181048 A1   9/2004  Wang
2006/0046257 A1*  3/2006  Pollock et al. .................. 435/6

FOREIGN PATENT DOCUMENTS

WO    WO 03/105758 A2   12/2003

OTHER PUBLICATIONS

Tockman et al (Cancer Res., 1992, 52:2711s-2718s).*
Stratagene catalog (p. 118, 1997/1998).
Affymetrix, "GeneChip® Human Genome Arrays", 4 pages.
Affymetrix, "Human Genome U133 Plus 2.0 Array", http://www.affymetrix.com/products/arrays/specific/hgu133plus.affx, 2 pages.

(Continued)

*Primary Examiner*—Sean E Aeder
(74) *Attorney, Agent, or Firm*—Ivor R. Elrifi; David E. Johnson; Mintz, Levin, Cohn, Ferris, Glovsky and Popeo PC

(57) ABSTRACT

Novel markers for ovarian cancer that are both sensitive and accurate. These markers are overexpressed and/or differentially expressed in ovarian cancer specifically, as opposed to normal ovarian tissue. The measurement of these markers, alone or in combination, in patient samples provides information that the diagnostician can correlate with a probable diagnosis, in ovarian cancer. The markers of the present invention, alone or in combination, show a high degree of differential detection between ovarian cancer and non-cancerous states.

5 Claims, 39 Drawing Sheets

OTHER PUBLICATIONS

Affymetrix, "Human Genome U133 Set", http://www.affymetrix.com/products/arrays/specific/hgu133.affx 2 pages.

Affymetrix, "Human Genome U133A 2.0 Array", http://www.affymetrix.com/products/arrays/specific/Hgu133av2.affx, 2 pages.

Barrett et al., "NCBI GEO: mining millions of expression profiles—database and tools", *Nucl. Acids Res.*, 33:D562-D566 (2005).

Bast, R., "Status of Tumor Markers in Ovarian Cancer Screening", *J. Clin. Oncol.*, 21(10):200s-205s (2003).

Boguski et al., "dbEST—database for 'expressed sequence tags'", *Nat. Genet.*, 4:332-333 (1993).

CBS, "Instructions", http://www.cbs.dtu.dk/services/TMHMM/TMHMM2.0b.guide.php, 3 pages, Oct. 29, 2003.

CBS, "Scientific Background", http://www.cbs.dtu.dk/services/SignalP/background/prediction.php, 2 pages, May 6, 2004.

Ch,EMBnet.org, "TMpred—Prediction of Transmembrane Regions and Orientation", http://www.ch.embnet.org/software/TMPRED_form.html, 1 page.

Edgar et al., "Gene Expression Omnibus: NCBI gene expression and hybridization array data repository", *Nucl. Acids Res.*, 30(1):207-210 (2002).

Fahrlander et al., "Amplifying DNA Probe Signals: A 'Christmas Tree' Approach", *Biotechnology*, 6:1165-1168 (1988).

Hazkani-Covo et al., "Evolution of multicellularity in Metoza: comparative analysis of the subcellular localization of proteins in Saccharomyces, Drosophila and Caenorhabditis", *Cell Biol. Int'l*, 28:171-178 (2004).

Hofmann et al., "A database of Membrane Spanning Protein Segments", *Biol. Chem.*, Abstract MF C-35, 374:166 (1993).

Komuro et al., "Surviving expression in ovarian carcinoma: correlation with apoptotic markers and prognosis", *Modern Pathol.*, 17:264 (2004).

Krogh et al., "Predicting Transmembrane Protein Topology with a Hidden Markov Model: Application to Complete Genomes", *J. Mol. Biol.*, 305:567-580 (2001).

Maggino et al., "Serum markers as prognostic factors in epithelial ovarian cancer: an overview", *Eur. J. Gynaec. Oncol.*, 21(1):64-69 (2000).

Meyer et al., "Role of tumor markers in monitoring epithelial ovarian cancer", *Brit. J. Cancer*, 82(9):1535-1538 (2000).

NCBI, "Expressed Sequence Tags database", http://www.ncbi.nlm.nih.gov/dbEST/, 2 pages, Jul. 11, 2000.

NCBI, "Genbank Overview", http://www.ncbi.nlm.nih.gov/Genbank/GenbankOverview.html, 2 pages, Sep. 20, 2004.

NCBI, "Gene Expression Omnibus", http://www.ncbi.nlm.nih.gov/projects/geo/, 1 page.

NCBI, "Geo Overview", http://www.ncbi.nlm.nih.gov/projects/geo/info/overview.html, 5 pages.

NCBI, "tissue-specific pattern of mRNA expression", http://www.ncbi.nlm.nih.gov/geo/query/acc.cgi?acc=GSE1133, 2 pages, Mar. 19, 2004.

Robertson et al., "Inhibins/activins as diagnostic markers for ovarian cancer", *Mol. Cell. Endocrinol.*, 191:97-103 (2002).

Sorek et al., "A novel algorithm for computational identification of contaminated EST libraries", *Nucl. Acids Res.*, 31(3):1067-1074 (2003).

Sorek et al., "*Alu*-Containing Exons are Alternatively Spliced", *Genome Res.*, 12:1060-1067 (2002).

Staibano et al., "Loss of oestrogen receptor β, high PCNA and p53 expression and aneuploidy as markers of worse prognosis in ovarian granulosa cell tumors", *Histopathology*, 43:254-262 (2003).

Su et al., "A gene atlas of the mouse and human protein-encoding transcriptomes", *PNAS*, 101(16):6062-6067 (2004).

Terry et al., "Blood and urine markers for ovarian cancer: A comprehensive review", *Disease Markers*, 20:53-70 (2004).

\* cited by examiner

Figure 1: Schematic description of the cancer biomarker selection engine.
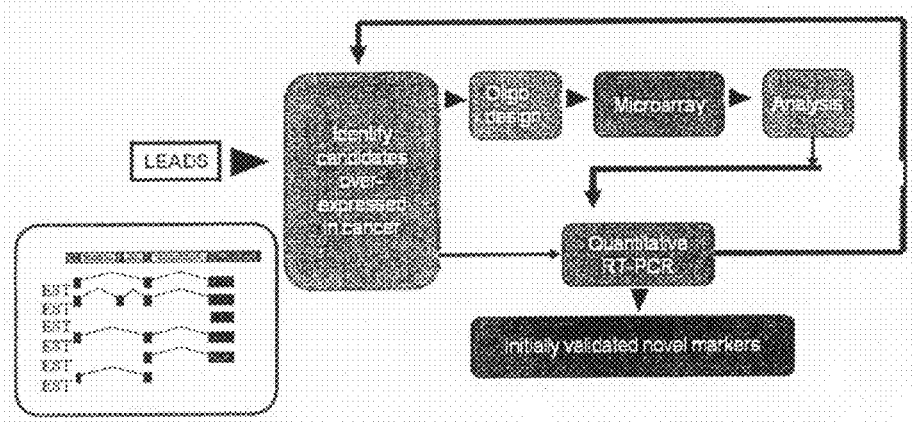
Figure 2: Schematic illustration, depicting grouping of transcripts of a given cluster based on presence or absence of unique sequence regions.
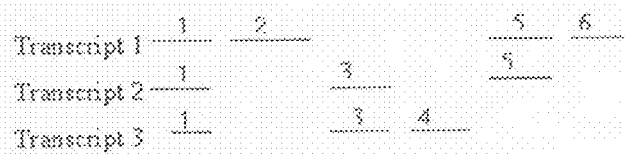

Figure 3: Schematic summary of quantitative real-time PCR analysis.

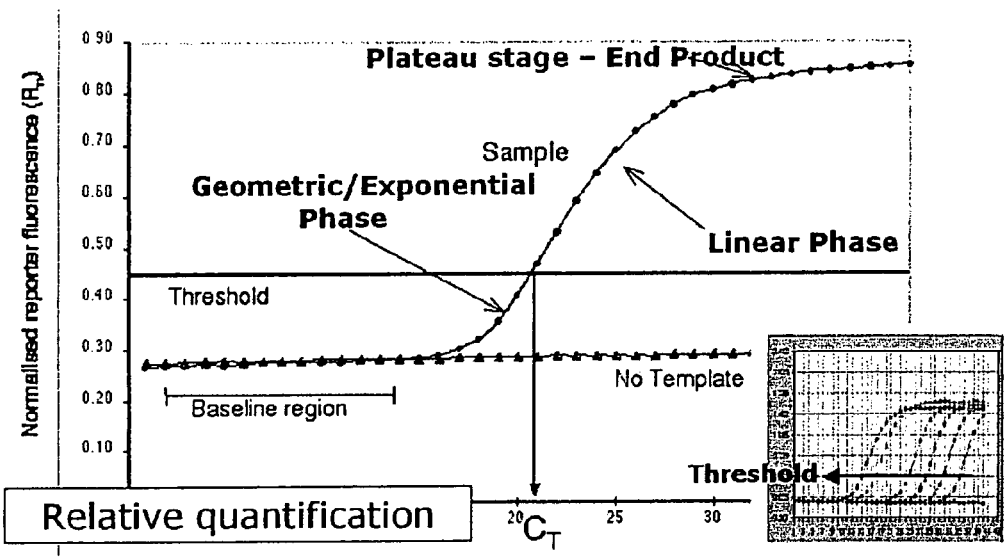

$C_T$ = Threshold Cycle point – A calculated cycle number in which PCR products signal is above the background level (passive dye ROX) and still in the Geometric/Expo phase.

Figure 4: Schematic presentation of the oligonucleotide based microarray fabrication

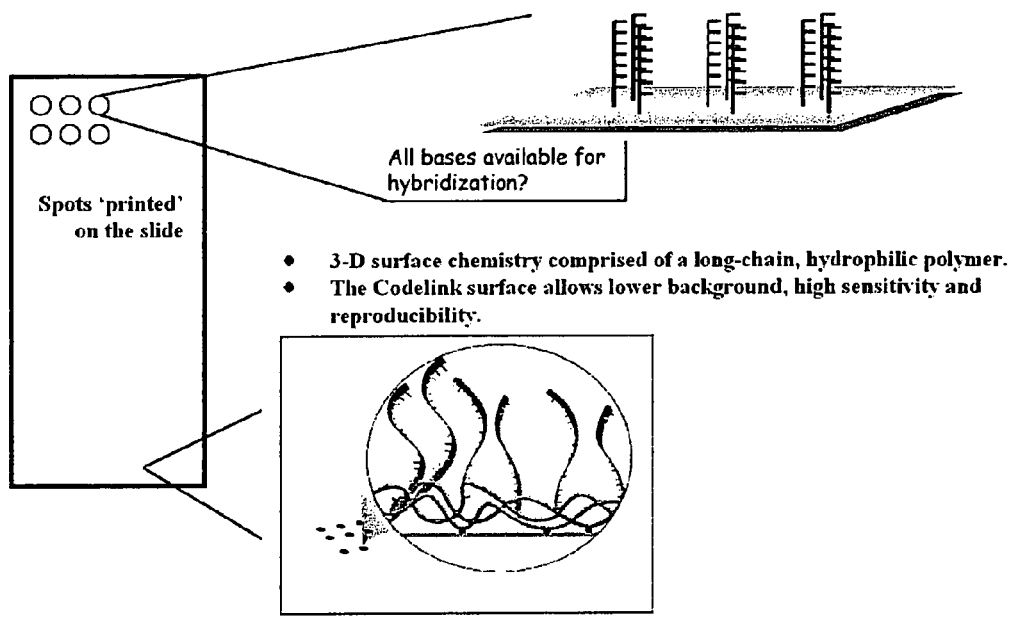

- 3-D surface chemistry comprised of a long-chain, hydrophilic polymer.
- The Codelink surface allows lower background, high sensitivity and reproducibility.

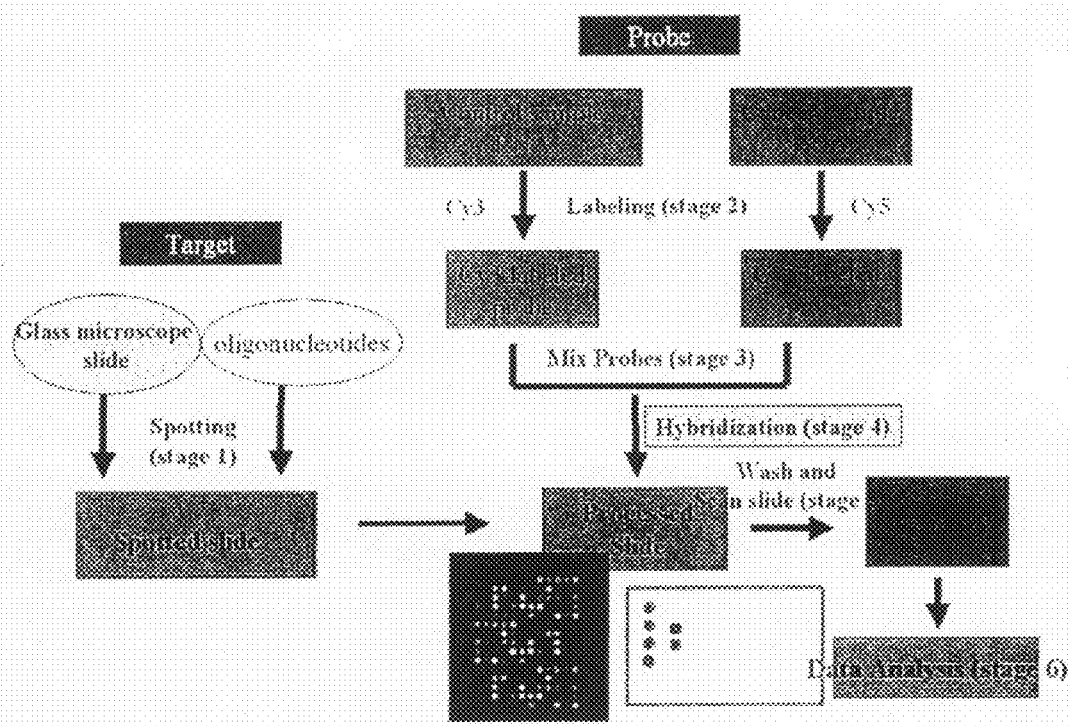
Figure 5: Schematic summary of the oligonucleotide based microarray experimental flow.
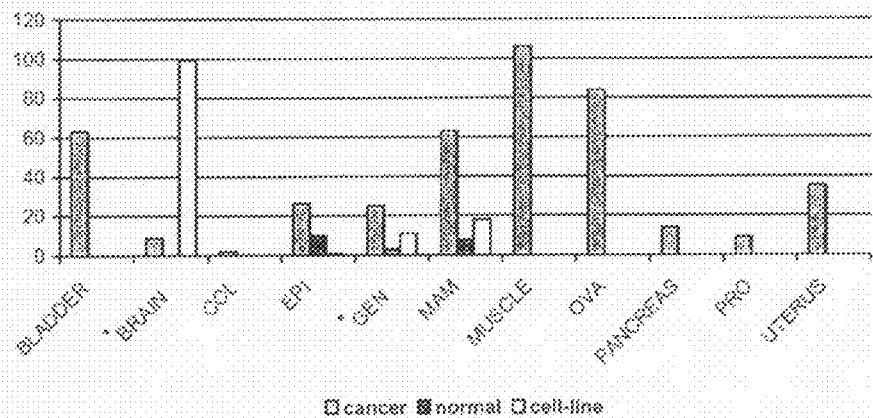
Figure 6:
Figure 6 - Cancer and cell-line vs. normal tissue expression Figure 9 - Cancer and cell-line vs. normal tissue expression Figure 12 - Cancer and cell-line vs. normal tissue expression Figure 15 - Cancer and cell-line vs. normal tissue expression Figure 20 - Cancer and cell-line vs. normal tissue expression Figure 25 - Cancer and cell-line vs. normal tissue expression Figure 29 - Cancer and cell-line vs. normal tissue expression

*Figure 32 - Cancer and cell-line vs. normal tissue expression*

Figure 42 - Cancer and cell-line vs. normal tissue expression

Figure 44 - Cancer and cell-line vs. normal tissue expression

NUCLEOTIDE AND AMINO ACID SEQUENCES, AND ASSAYS AND METHODS OF USE THEREOF FOR DIAGNOSIS OF OVARIAN CANCER

CROSS-REFERENCE TO RELATED APPLICATION(S)

THIS APPLICATION IS RELATED TO NOVEL NUCLEOTIDE AND AMINO ACID SEQUENCES, AND ASSAYS AND METHODS OF USE THEREOF FOR DIAGNOSIS OF OVARIAN CANCER, AND CLAIMS PRIORITY AS A CONTINUATION TO U.S. APPLICATION No. 11/050,857, FILED Jan. 27, 2005 now abandoned, WHICH IS HEREBY INCORPORATED BY REFERENCE AS IF FULLY SET FORTH HEREIN, WHICH IN TURN CLAIMS PRIORITY TO AND INCORPORATES HEREIN BY REFERENCE (IN THEIR ENTIRETY) EACH OF THE CORRESPONDING U.S. PROVISIONAL APPLICATIONS NOTED BELOW:

APPLICATION No. 60/620,916 FILED Oct. 22, 2004—DIFFERENTIAL EXPRESSION OF MARKERS IN COLON CANCER

APPLICATION No. 60/628,123 FILED Nov. 17, 2004—DIFFERENTIAL EXPRESSION OF MARKERS IN COLON CANCER II

APPLICATION No. 60/621,131 FILED Oct. 25, 2004—DIAGNOSTIC MARKERS FOR COLON CANCER, AND ASSAYS AND METHODS OF USE THEREOF

APPLICATION No. 60/620,917 FILED Oct. 22, 2004—DIFFERENTIAL EXPRESSION OF MARKERS IN BREAST CANCER

APPLICATION No. 60/628,101 FILED Nov. 17, 2004—DIFFERENTIAL EXPRESSION OF MARKERS IN BREAST CANCER II

APPLICATION No. 60/620,874 FILED Oct. 22, 2004—DIFFERENTIAL EXPRESSION OF MARKERS IN OVARIAN CANCER

APPLICATION No. 60/628,134 FILED Nov. 17, 2004—DIFFERENTIAL EXPRESSION OF MARKERS IN OVARIAN CANCER II

APPLICATION No. 60/620,924 FILED Oct. 22, 2004—DIFFERENTIAL EXPRESSION OF MARKERS IN STOMACH CANCER

APPLICATION No. 60/628,111 FILED Nov. 17, 2004—DIFFERENTIAL EXPRESSION OF MARKERS IN STOMACH CANCER II

APPLICATION No. 60/620,853 FILED Oct. 22, 2004—28814—DIFFERENTIAL EXPRESSION OF MARKERS IN LUNG CANCER

APPLICATION No. 60/628,112 FILED Nov. 17, 2004—DIFFERENTIAL EXPRESSION OF MARKERS IN LUNG CANCER II

APPLICATION No. 60/620,974 FILED Oct. 22, 2004—DIFFERENTIAL EXPRESSION OF MARKERS IN PANCREATIC CANCER

APPLICATION No. 60/628,145 FILED Nov. 17, 2004—DIFFERENTIAL EXPRESSION OF MARKERS IN PANCREATIC CANCER II

APPLICATION No. 60/620,656 FILED Oct. 22, 2004—DIFFERENTIAL EXPRESSION OF MARKERS IN PROSTATE CANCER

APPLICATION No. 60/628,251 FILED Nov. 17, 2004—DIFFERENTIAL EXPRESSION OF MARKERS IN PROSTATE CANCER II

APPLICATION No. 60/620,975 FILED Oct. 22, 2004—DIFFERENTIAL EXPRESSION OF MARKERS IN BRAIN CANCER

APPLICATION No. 60/628,178 FILED Nov. 17, 2004—DIFFERENTIAL EXPRESSION OF MARKERS IN BRAIN CANCER II

APPLICATION No. 60/622,320 FILED Oct. 27, 2004—DIAGNOSTIC MARKERS FOR CARDIAC DISEASE AND/OR PATHOLOGICAL CONDITIONS, AND ASSAYS AND METHODS OF USE THEREOF

APPLICATION No. 60/628,190 FILED Nov. 17, 2004—DIAGNOSTIC MARKERS FOR CARDIAC DISEASE AND/OR PATHOLOGICAL CONDITIONS, AND ASSAYS AND METHODS OF USE THEREOF II

APPLICATION No. 60/630,559 FILED Nov. 26, 2004—DIAGNOSTIC MARKERS FOR CARDIAC DISEASE AND/OR PATHOLOGICAL CONDITIONS, AND ASSAYS AND METHODS OF USE THEREOF II

APPLICATION No. 60/628,231 FILED Nov. 17, 2004—NOVEL DIAGNOSTIC SERUM MARKERS, AND ASSAYS AND METHODS OF USE THEREOF

APPLICATION No. 60/620,918 FILED Oct. 22, 2004—DIAGNOSTIC MARKERS FOR RENAL CANCER, AND ASSAYS AND METHODS OF USE THEREOF

APPLICATION No. 60/628,156 FILED Nov. 17, 2004—DIAGNOSTIC MARKERS FOR RENAL CANCER, AND ASSAYS AND METHODS OF USE THEREOF II

APPLICATION No. 60/620,677 FILED Oct. 22, 2004—DIFFERENTIAL EXPRESSION OF MARKERS IN BLADDER CANCER

APPLICATION No. 60/628,167 FILED Nov. 17, 2004—DIFFERENTIAL EXPRESSION OF MARKERS IN BLADDER CANCER II

APPLICATION No. 60/621,004 FILED Oct. 22, 2004—DIFFERENTIAL EXPRESSION OF MARKERS IN SKIN AND EPITHELIAL CANCER II

APPLICATION No. 60/628,179 FILED Nov. 17, 2004—NOVEL DIAGNOSTIC MARKERS, AND ASSAYS AND METHODS OF USE THEREOF

APPLICATION No. 60/622,017 FILED Oct. 27, 2004—VARIANTS OF NONSPECIFIC ALKALINE PHOSPHATASE, USE OF DIAGNOSTIC MARKERS, AND ASSAYS AND METHODS OF USE THEREOF

APPLICATION No. 60/539,129 FILED Jan. 27, 2004—METHODS AND SYSTEMS FOR ANNOTATING BIOMOLECULAR SEQUENCES

AND APPLICATION No. 60/539,128 FILED Jan. 27, 2004—EVOLUTIONARY CONSERVED SPLICED SEQUENCES AND METHODS AND SYSTEMS FOR IDENTIFYING THEREOF

FIELD OF THE INVENTION

The present invention is related to novel nucleotide and protein sequences that are diagnostic markers for ovarian cancer, and assays and methods of use thereof. The "Sequence Listing" recited on the computer readable form (CRF) CD filed herewith is incorporated herein by reference in its entirety.

BACKGROUND OF THE INVENTION

Ovarian cancer causes more deaths than any other cancer of the female reproductive system. An estimated 25,580 new cases will be diagnosed during 2004 in the United States, and approximately 16,090 of these women will die of the disease. Despite advances in the management of advanced ovarian cancer, 70% to 80% of patients will ultimately succumb to disease that is diagnosed in late stages. When ovarian cancer is diagnosed in stage I, more than 90% of patients can be cured with conventional surgery and chemotherapy. At present, however, only 25% of ovarian cancers are detected in stage I. Detection of a greater fraction of ovarian cancers at an early stage might significantly affect survival. A worldwide research effort, aiming at early detection of ovarian cancer, is currently being performed; finding molecular markers for the disease is one of the major research topics (J Clin Oncol. 2003 May 15; 21(10 Suppl):200-5).

No single marker has been shown to be sufficiently sensitive or specific to contribute to the diagnosis of ovarian cancer. The marker that is currently most frequently used is CA-125 (Br J Cancer. 2000 May; 82(9):1535-8). Its properties do not support its use for screening, but it is a major diagnostic tool. CA-125 is a member of the epithelial sialomucins markers group and is the most well documented and the best performing single marker from this group. Another name for CA-125 is mucin 16, and although it is a membrane protein, it can be found in the serum. Its greatest sensitivity is achieved for serous and emdometrioid ovarian tumors compared to mucinous or clear cell tumors. Other than diagnosis, it can be used for disease monitoring (Eur J Gynaecol Oncol. 2000; 21(1):64-9). In about 70% of patients, a rising level of CA-125 may be the first indication of relapse, predating clinical relapse by a median of 4 months. The serum concentration of CA-125 is elevated by the vascular invasion, tissue destruction and inflammation associated with malignant disease and is elevated in over 90% of those women with advanced ovarian cancer. Yet, CA-125 is not specific to ovarian cancer. It is elevated in 40% of all patients with advanced intra-abdominal malignancy. Levels can also be elevated during menstruation or pregnancy and in other benign conditions such as endometriosis, peritonitis or cirrhosis, particularly with ascites. CA-125 is not a marker that can be detected through use of urine samples due to a high molecular weight.

There are other ovarian cancer markers originating from epithelial mucins but none can replace CA-125, due to poorer specificity and sensitivity. These other markers may prove complementary to CA-125. CA-50, CA 54-61, CA-195 and CA 19-9 all appear to have greater sensitivity for detection of mucinous tumors while STN and TAG-72 have better sensitivity for detection of clear cell tumors (Dis Markers. 2004; 20(2):53-70).

Kallikreins, a family of serine proteases, and other protease-related proteins are also potential markers for ovarian cancer. Indeed, the entire family of kallikreins map to a region on chromosome 19q which is shown to be amplified in ovarian cancers. In particular, kallikrein 6 (protease M) and kallilrein 10 have been reported to have sensitivity up to 75% and specificity up to 100%. Matrix metalloproteinases (MMPs) are another family of proteases useful in ovarian cancer screening and prognosis. MMP-2 was reported to have 66% sensitivity and 100% specificity in one study. Cathepsin L, a cystein protease, was described to have a lower false positive rate compared with CA-125. Based on their biochemical proteolytic role, it would seem likely that these proteases would be active in invasion and metastasis formation and indeed these markers appear to have higher sensitivity for advanced stages of the disease. Due to their relatively low molecular weight, such proteases are candidates to be urine markers, or markers which can be detected in urine samples (Dis Markers. 2004; 20(2):53-70).

Hormones have a role in normal ovarian physiology. Therefore, it is not surprising that hormones, and growth and inhibition factors as well, are suitable for ovarian cancer detection. Measurements of fragments of gonadotropin in the urine were found to have sensitivity up to 83% and specificity up to 92% for detecting ovarian cancer. Inhibins, members of the Transforming Growth Factors (TGF) beta superfamily, have been shown to have a diagnostic value in the detection of granulosa cell tumor, a relatively uncommon type of ovarian cancer, associated with better prognosis overall. Serum inhibin is an ovarian product which decreases to non detectable levels after menopause, however, certain ovarian cancers (mucinous carcinomas and sex cord stromal tumours such as granulosa cell tumours) continue to produce inhibin. Studies have shown that that inhibin assays which detect all inhibin forms (as opposed to test detecting specific members of the inhibins family) provide the highest sensitivity/specificity characteristics as an ovarian cancer diagnostic test (Mol Cell Endocrinol. 2002 May 31; 191(1):97-103). Measurement of serum TGF-alpha itself was found to have sensitivity up to 70% and specificity of 89% in early stage disease. The growth factor Mesothelin was also found to have diagnostic value but only for late stage disease.

Immunohistochemistry is frequently used to assess the origin of tumor and staging when a pathological tissue sample is available. A few molecular markers have been shown to have diagnostic value in Immunohistochemistry of ovarian cancer, among them Epidermal Growth Factor, p53 and HER-2. P53 expression is much lower at early stage than late stage disease. P53 high expression is more typical or characteristic of invasive serous tumors than of mucinous tumors. No benign tumors are stained with P53. HER-2 is found in less than 25% of newly diagnosed ovarian cancers. Ovarian cancer of type granulosa cell tumor has in general better prognosis with late relapse and/or metastasis formation. However, about 50% of patients still die within 20 years of diagnosis. In this specific tumor type, immunohistochemistry staining of estrogen receptor beta (ERb) and proliferating cell nuclear antigen (PCNA) showed that loss of ERb expression and high PCNA expression, characterized a subgroup of granulosa cell tumors with a worse outcome (Histopathology. 2003 September; 43(3):254-62). Survivin expression was also shown to be correlated to tumor grade, histologic type and mutant p53 but actual correlation to survival is questionable (Mod Pathol. 2004 February; 17(2):264)

Many other markers have been tested over the years for ovarian cancer detection. Some markers have shown only limited value while others are still under investigation. Among them are TPA and TPS, two cytokeratins whose inclusion in a panel with CA-125 resulted in diagnoses with sensitivity up to 93% and specificity up to 98%. LPA—lysophosphatidic acid—was a very promising marker with one study demonstrating 98% sensitivity and 90% specificity. However, this marker is very unstable and requires quick processing and freezing of plasma, and therefore has limited usage.

As previously described, no single marker has been shown to be sufficiently sensitive or specific to contribute to the diagnosis of ovarian cancer. Therefore combinations of markers in panel are being tested. Usually CA-125 is one of the panel members. The best performing panel combinations so far have been CA-125 with CA 15-3 with sensitivity of 93% and specificity of 93%, CA-125 with CEA (which has very little sensitivity by itself) with specificity of 93% and specificity of 93%, and CA-125 with TAG-72 and CA 15-3 where specificity becomes 95% but sensitivity is diminished (Dis Markers. 2004; 20(2):53-70).

SUMMARY OF THE INVENTION

The background art does not teach or suggest markers for ovarian cancer that are sufficiently sensitive and/or accurate, alone or in combination.

The present invention overcomes these deficiencies of the background art by providing novel markers for ovarian cancer that are both sensitive and accurate. These markers are differentially expressed and preferably overexpressed in ovarian cancer specifically, as opposed to normal ovarian tissue. The measurement of these markers, alone or in combination, in patient (biological) samples provides information that the diagnostician can correlate with a probable diagnosis of ovarian cancer. The markers of the present invention, alone or in combination, show a high degree of differential detection between ovarian cancer and non-cancerous states.

According to preferred embodiments of the present invention, examples of suitable biological samples which may optionally be used with preferred embodiments of the present invention include but are not limited to blood, serum, plasma, blood cells, urine, sputum, saliva, stool, spinal fluid or CSF, lymph fluid, the external secretions of the skin, respiratory, intestinal, and genitourinary tracts, tears, milk, neuronal tissue, ovarian tissue, any human organ or tissue, including any tumor or normal tissue, any sample obtained by lavage (for example of the bronchial system or of the female reproductive system), and also samples of in vivo cell culture constituents. In a preferred embodiment, the biological sample comprises ovarian tissue and/or a serum sample and/or a urine sample and/or secretions or other samples from the female reproductive system and/or any other tissue or liquid sample. The sample can optionally be diluted with a suitable eluant before contacting the sample to an antibody and/or performing any other diagnostic assay.

Information given in the text with regard to cellular localization was determined according to four different software programs: (i) tmhmm (from Center for Biological Sequence Analysis, Technical University of Denmark DTU, cbs.dtu.dk/services/TMHMM/TMHMM2.0b.guide.php) or (ii) tmpred (from EMBnet, maintained by the ISREC Bionformatics group and the LICR Information Technology Office, Ludwig Institute for Cancer Research, Swiss Institute of Bioinformatics, ch.embnet.org/software/TMPRED_form.html) for transmembrane region prediction; (iii) signalp_hmm or (iv) signalp_nn (both from Center for Biological Sequence Analysis, Technical University of Denmark DTU, cbs.dtu.dk/services/SignalP/background/prediction.php) for signal peptide prediction. The terms "signalp_hmm" and "signalp_nn" refer to two modes of operation for the program SignalP: hmm refers to Hidden Markov Model, while nn refers to neural networks. Localization was also determined through manual inspection of known protein localization and/or gene structure, and the use of heuristics by the individual inventor. In some cases for the manual inspection of cellular localization prediction inventors used the ProLoc computational platform [Einat Hazkani-Covo, Erez Levanon, Galit Rotman, Dan Graur and Amit Novik; (2004) "Evolution of multicellularity in metazoa: comparative analysis of the subcellular localization of proteins in *Saccharomyces, Drosophila* and *Caenorhabditis*." Cell Biology International 2004; 28(3):171-8.], which predicts protein localization based on various parameters including, protein domains (e.g., prediction of trans-membranous regions and localization thereof within the protein), pI, protein length, amino acid composition, homology to pre-annotated proteins, recognition of sequence patterns which direct the protein to a certain organelle (such as, nuclear localization signal, NLS, mitochondria localization signal), signal peptide and anchor modeling and using unique domains from Pfam that are specific to a single compartment.

Information is given in the text with regard to SNPs (single nucleotide polymorphisms). A description of the abbreviations is as follows. "T->C", for example, means that the SNP results in a change at the position given in the table from T to C. Similarly, "M->Q", for example, means that the SNP has caused a change in the corresponding amino acid sequence, from methionine (M) to glutamine (Q). If, in place of a letter at the right hand side for the nucleotide sequence SNP, there is a space, it indicates that a frameshift has occurred. A frameshift may also be indicated with a hyphen (-). A stop codon is indicated with an asterisk at the right hand side (*). As part of the description of an SNP, a comment may be found in parentheses after the above description of the SNP itself. This comment may include an FTId, which is an identifier to a SwissProt entry that was created with the indicated SNP. An FTId is a unique and stable feature identifier, which allows construction of links directly from position-specific annotation in the feature table to specialized protein-related databases. The FTId is always the last component of a feature in the description field, as follows: FTId=XXX_number, in which XXX is the 3-letter code for the specific feature key, separated by an underscore from a 6-digit number. In the table of the amino acid mutations of the wild type proteins of the selected splice variants of the invention, the header of the first column is "SNP position(s) on amino acid sequence", representing a position of a known mutation on amino acid sequence. SNPs may optionally be used as diagnostic markers according to the present invention, alone or in combination with one or more other SNPs and/or any other diagnostic marker. Preferred embodiments of the present invention comprise such SNPs, including but not limited to novel SNPs on the known (WT or wild type) protein sequences given below, as well as novel nucleic acid and/or amino acid sequences formed through such SNPs, and/or any SNP on a variant amino acid and/or nucleic acid sequence described herein.

Information given in the text with regard to the Homology to the known proteins was determined by Smith-Waterman version 5.1.2 using special (non default) parameters as follows:

model=sw.model

GAPEXT=0

GAPOP=100.0

MATRIX=blosum100

Information is given with regard to overexpression of a cluster in cancer based on ESTs. A key to the p values with regard to the analysis of such overexpression is as follows:

library-based statistics: P-value without including the level of expression in cell-lines (PI)

library based statistics: P-value including the level of expression in cell-lines (P2)

EST clone statistics: P-value without including the level of expression in cell-lines (SP1)

EST clone statistics: predicted overexpression ratio without including the level of expression in cell-lines (R3)

EST clone statistics: P-value including the level of expression in cell-lines (SP2)

EST clone statistics: predicted overexpression ratio including the level of expression in cell-lines (R4)

Library-based statistics refer to statistics over an entire library, while EST clone statistics refer to expression only for ESTs from a particular tissue or cancer.

Information is given with regard to overexpression of a cluster in cancer based on microarrays. As a microarray reference, in the specific segment paragraphs, the unabbreviated tissue name was used as the reference to the type of chip for which expression was measured.

There are two types of microarray results: those from microarrays prepared according to a design by the present inventors, for which the microarray fabrication procedure is described in detail in Materials and Experimental Procedures section herein; and those results from microarrays using Affymetrix technology. As a microarray reference, in the specific segment paragraphs, the unabbreviated tissue name was used as the reference to the type of chip for which expression was measured. For microarrays prepared according to a design by the present inventors, the probe name begins with the name of the cluster (gene), followed by an identifying number. These probes are listed below with their respective sequences.

>H61775_0_11_0 (SEQ ID NO:1031)

CCCCAGCTTTTATAGAGCGGCCCAAG-GAAGAATATTTCCAAGAAGTAGGG

>HSAPHOL_0_11_0 (SEQ ID NO:1012)

GGAACATTCTGGATCTGACCCTC-CCAGTCTCATCTCCTGACCCTCCCACT

>HUMGRP5E_0_0_16630 (SEQ ID NO:1013)

GCTGATATGGAAGTTGGGGAATCTGAAT-TGCCAGAGAATCTTGGGAAGAG

>HUMGRP5E_0_2_0 (SEQ ID NO:1014)

TCTCATAGAAGCAAAGGAGAACAGAAAC-CACCAGCCACCTCAACCCAAGG

>D56406_0_5_0 (SEQ ID NO:1015)

TCTGACTTTTACGGACTTGGCTTGTTA-GAAGGCTGAAAGATGATGGCAGG

>M77904_0_8_0 (SEQ ID NO:1016)

AGTCTGTGTTTGAGGGTGAAGGCTCAG-CAACCCTGATGTCTGCCAACTAC

>Z25299_0_3_0 (SEQ ID NO:1017)

AACTCTGGCACCTTGGGCTGTGGAAG-GCTCTGGAAAGTCCTTCAAAGCTG

>Z44808_0_8_0 (SEQ ID NO:1018)

AAAAGCATGAGTTTCTGACCAGCGT-TCTGGACGCGCTGTCCACGGACATG

>Z44808_0_0_72347 (SEQ ID NO:1019)

ATGTTCTTAGGAGGCAAGCCAG-GAGAAGCCGGGTCTGACTTTTCAGCTCA

>Z44808_0_0_72349 (SEQ ID NO:1020)

TCCTCCAGACCCAAAGCCACAAC-CCATCGCAAGTCAAGAACACTTTCCAG

>S67314_0_0_741 (SEQ ID NO: 1021)

CACAGAGCCAGGATGTTCTTCTGACCT-CAGTATCTACTCCAGCTCCAGCT

>S67314_0_0_744 (SEQ ID NO:1022)

TGGCATGCTGGAACATG-GACTCTAGCTAGCAAGAAGGGCTCAAGGAGGTG

>Z39337_0_0_66755 (SEQ ID NO:1023)

GCAGGGGTTAAAAGGACGTTCCAGAAG-CATCTGGGGACAGAACCAGCCTC

>Z39337_0_9_0 (SEQ ID NO:1024)

TAATAAACGCAGCGACGTGAGGGTCCT-GATTCTCCCTGGTTTTACCCCAG

>HUMPHOSLIP_0_0_18458 (SEQ ID NO:1025)

AAGGAAGCAGGACCAGTGGATGTGAG-GCGTGGTCGAAGAACAACAGAAAG

>HUMPHOSLIP_0_0_18487 (SEQ ID NO:1026)

ACAGGGGCCAGATGGTGACCCATGAC-CCAGCCTAAAAGGCAGCCAGAGGG

>M78530_0_6_0 (SEQ ID NO:1027)

CTTCCTACACACATCTAGACGT-TCAAGTTTGCAAATCAGTTTTTAGCAAG

>HSMUC1A_0_37_0 (SEQ ID NO:1028)

AAAAGGAGACTTCGGCTACCCA-GAGAAGTTCAGTGCCCAGCTCTACTGAG

>HSMUC1A_0_0_11364 (SEQ ID NO: 1029)

AAAGGCTGGCATAGGGGGAGGTTTC-CCAGGTAGAAGAAGAAGTGTCAGCA

>HSMUC1A_0_0_11365 (SEQ ID NO:1030)

AATTAACCCTTTGAGAGCTGGCCAG-GACTCTGGACTGATTACCCCAGCCT

Oligonucleotide microarray results taken from Affymetrix data were from chips available from Affymetrix Inc, Santa Clara, Calif., USA (see for example data regarding the Human Genome U133 (HG-U133) Set at www.affymetrix.com/products/arrays/specific/hgu133.affx; GeneChip Human Genome U133A 2.0 Array at www.affymetrix.com/products/arrays/specific/hgu133av2.affx; and Human Genome U133 Plus 2.0 Array at www.affymetrix.com/products/arrays/specific/hgu133plus.affx). The probe names follow the Affymetrix naming convention. The data is available from NCBI Gene Expression Omnibus (see www.ncbi.nlm.nih.gov/projects/geo/ and Edgar et al., Nucleic Acids Research, 2002, Vol. 30, No. 1 207-210). The dataset (including results) is available from www.ncbi.nlm.nih.gov/geo/query/acc.cgi?acc=GSE1133 for the Series GSE1133 database (published on March 2004); a reference to these results is as follows: Su et al. (Proc Natl Acad Sci USA. 2004 Apr. 20; 101(16):6062-7. Epub 2004 Apr. 9).

The following list of abbreviations for tissues was used in the TAA histograms. The term "TAA" stands for "Tumor Associated Antigen", and the TAA histograms, given in the text, represent the cancerous tissue expression pattern as predicted by the biomarkers selection engine, as described in detail in examples 1-5 below (the first word is the abbreviation while the second word is the full name):

("BONE", "bone");

("COL", "colon");

("EPI", "epithelial");

("GEN", "general");

("LIVER", "liver");

("LUN", "lung");

("LYMPH", "lymph nodes");

("MARROW", "bone marrow");

("OVA", "ovary");

("PANCREAS", "pancreas");

("PRO", "prostate");

("STOMACH", "stomach");

("TCELL", "T cells");

("THYROID", "Thyroid");

("MAM", "breast");

("BRAIN", "brain");

("UTERUS", "uterus");

("SKIN", "skin");

("KIDNEY", "kidney");

("MUSCLE", "muscle");

("ADREN", "adrenal");

("HEAD", "head and neck");

("BLADDER", "bladder");

It should be noted that the terms "segment", "seg" and "node" are used interchangeably in reference to nucleic acid sequences of the present invention; they refer to portions of nucleic acid sequences that were shown to have one or more properties as described below. They are also the building blocks that were used to construct complete nucleic acid sequences as described in greater detail below. Optionally and preferably, they are examples of oligonucleotides which are embodiments of the present invention, for example as amplicons, hybridization units and/or from which primers and/or complementary oligonucleotides may optionally be derived, and/or for any other use.

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). All of these are hereby incorporated by reference as if fully set forth herein. As used herein, the following terms have the meanings ascribed to them unless specified otherwise.

As used herein the phrase "ovarian cancer" refers to cancers of the ovary including but not limited to Ovarian epithelial tumors (serous, mucinous, endometroid, clear cell, and Brenner tumor), ovarian germ-cell tumors, (teratoma, dysgerminoma, endodermal sinus tumor, and embryonal carcinoma) and ovarian stromal tumors (originating from granulosa, theca, Sertoli, Leydig, and collagen-producing stromal cells).

The term "marker" in the context of the present invention refers to a nucleic acid fragment, a peptide, or a polypeptide, which is differentially present in a sample taken from subjects (patients) having ovarian cancer as compared to a comparable sample taken from subjects who do not have ovarian cancer.

The phrase "differentially present" refers to differences in the quantity of a marker present in a sample taken from patients having ovarian cancer as compared to a comparable sample taken from patients who do not have ovarian cancer. For example, a nucleic acid fragment may optionally be differentially present between the two samples if the amount of the nucleic acid fragment in one sample is significantly different from the amount of the nucleic acid fragment in the other sample, for example as measured by hybridization and/or NAT-based assays. A polypeptide is differentially present between the two samples if the amount of the polypeptide in one sample is significantly different from the amount of the polypeptide in the other sample. It should be noted that if the marker is detectable in one sample and not detectable in the other, then such a marker can be considered to be differentially present.

As used herein the phrase "diagnostic" means identifying the presence or nature of a pathologic condition. Diagnostic methods differ in their sensitivity and specificity. The "sensitivity" of a diagnostic assay is the percentage of diseased individuals who test positive (percent of "true positives"). Diseased individuals not detected by the assay are "false negatives." Subjects who are not diseased and who test negative in the assay are termed "true negatives." The "specificity" of a diagnostic assay is 1 minus the false positive rate, where the "false positive" rate is defined as the proportion of those without the disease who test positive. While a particular diagnostic method may not provide a definitive diagnosis of a condition, it suffices if the method provides a positive indication that aids in diagnosis.

As used herein the phrase "diagnosing" refers to classifying a disease or a symptom, determining a severity of the disease, monitoring disease progression, forecasting an outcome of a disease and/or prospects of recovery. The term "detecting" may also optionally encompass any of the above.

Diagnosis of a disease according to the present invention can be effected by determining a level of a polynucleotide or a polypeptide of the present invention in a biological sample obtained from the subject, wherein the level determined can be correlated with predisposition to, or presence or absence of the disease. It should be noted that a "biological sample obtained from the subject" may also optionally comprise a sample that has not been physically removed from the subject, as described in greater detail below.

As used herein, the term "level" refers to expression levels of RNA and/or protein or to DNA copy number of a marker of the present invention.

Typically the level of the marker in a biological sample obtained from the subject is different (i.e., increased or decreased) from the level of the same variant in a similar sample obtained from a healthy individual (examples of biological samples are described herein).

Numerous well known tissue or fluid collection methods can be utilized to collect the biological sample from the subject in order to determine the level of DNA, RNA and/or polypeptide of the variant of interest in the subject.

Examples include, but are not limited to, fine needle biopsy, needle biopsy, core needle biopsy and surgical biopsy (e.g., brain biopsy), and lavage. Regardless of the procedure employed, once a biopsy/sample is obtained the level of the variant can be determined and a diagnosis can thus be made.

Determining the level of the same variant in normal tissues of the same origin is preferably effected along-side to detect an elevated expression and/or amplification and/or a decreased expression, of the variant as opposed to the normal tissues.

A "test amount" of a marker refers to an amount of a marker in a subject's sample that is consistent with a diagnosis of ovarian cancer. A test amount can be either in absolute amount (e.g., microgram/ml) or a relative amount (e.g., relative intensity of signals).

A "control amount" of a marker can be any amount or a range of amounts to be compared against a test amount of a marker. For example, a control amount of a marker can be the amount of a marker in a patient with ovarian cancer or a person without ovarian cancer. A control amount can be either in absolute amount (e.g., microgram/ml) or a relative amount (e.g., relative intensity of signals).

"Detect" refers to identifying the presence, absence or amount of the object to be detected.

A "label" includes any moiety or item detectable by spectroscopic, photo chemical, biochemical, immunochemical, or chemical means. For example, useful labels include $^{32}P$, $^{35}S$, fluorescent dyes, electron-dense reagents, enzymes (e.g., as commonly used in an ELISA), biotin-streptavadin, dioxigenin, haptens and proteins for which antisera or monoclonal antibodies are available, or nucleic acid molecules with a sequence complementary to a target. The label often generates a measurable signal, such as a radioactive, chromogenic, or fluorescent signal, that can be used to quantify the amount of bound label in a sample. The label can be incorporated in or attached to a primer or probe either covalently, or through ionic, van der Waals or hydrogen bonds, e.g., incorporation of radioactive nucleotides, or biotinylated nucleotides that are recognized by streptavadin. The label may be directly or indirectly detectable. Indirect detection can involve the binding of a second label to the first label, directly or indirectly. For example, the label can be the ligand of a binding partner, such as biotin, which is a binding partner for streptavadin, or a nucleotide sequence, which is the binding partner for a complementary sequence, to which it can specifically hybridize. The binding partner may itself be directly detectable, for example, an antibody may be itself labeled with a fluorescent molecule. The binding partner also may be indirectly detectable, for example, a nucleic acid having a complementary nucleotide sequence can be a part of a branched DNA molecule that is in turn detectable through hybridization with other labeled nucleic acid molecules (see, e.g., P. D. Fahrlander and A. Klausner, Bio/Technology 6:1165 (1988)). Quantitation of the signal is achieved by, e.g., scintillation counting, densitometry, or flow cytometry.

Exemplary detectable labels, optionally and preferably for use with immunoassays, include but are not limited to magnetic beads, fluorescent dyes, radiolabels, enzymes (e.g., horse radish peroxide, alkaline phosphatase and others commonly used in an ELISA), and calorimetric labels such as colloidal gold or colored glass or plastic beads. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

"Immunoassay" is an assay that uses an antibody to specifically bind an antigen. The immunoassay is characterized by the use of specific binding properties of a particular antibody to isolate, target, and/or quantify the antigen.

The phrase "specifically (or selectively) binds" to an antibody or "specifically (or selectively) immunoreactive with," when referring to a protein or peptide (or other epitope), refers to a binding reaction that is determinative of the presence of the protein in a heterogeneous population of proteins and other biologics. Thus, under designated immunoassay conditions, the specified antibodies bind to a particular protein at least two times greater than the background (non-specific signal) and do not substantially bind in a significant amount to other proteins present in the sample. Specific binding to an antibody under such conditions may require an antibody that is selected for its specificity for a particular protein. For example, polyclonal antibodies raised to seminal basic protein from specific species such as rat, mouse, or human can be selected to obtain only those polyclonal antibodies that are specifically immunoreactive with seminal basic protein and not with other proteins, except for polymorphic variants and alleles of seminal basic protein. This selection may be achieved by subtracting out antibodies that cross-react with seminal basic protein molecules from other species. A variety of immunoassay formats may be used to select antibodies specifically immunoreactive with a particular protein. For example, solid-phase ELISA immunoassays are routinely used to select antibodies specifically immunoreactive with a protein (see, e.g., Harlow & Lane, Antibodies, A Laboratory Manual (1988), for a description of immunoassay formats and conditions that can be used to determine specific immunoreactivity). Typically a specific or selective reaction will be at least twice background signal or noise and more typically more than 10 to 100 times background.

According to preferred embodiments of the present invention, there is provided an isolated polynucleotide comprising a nucleic acid sequence in the table below and/or:

| Transcript Name | |
|---|---|
| H61775_T21 | (SEQ ID NO. 1) |
| H61775_T22 | (SEQ ID NO: 2) | a nucleic acid sequence comprising a sequence in the table below:

| Segment Name | |
|---|---|
| H61775_node_2 | (SEQ ID NO: 3) |
| H61775_node_4 | (SEQ ID NO: 4) |
| H61775_node_6 | (SEQ ID NO: 5) |
| H61775_node_8 | (SEQ ID NO: 6) |
| H61775_node_0 | (SEQ ID NO: 7) |
| H61775_node_5 | (SEQ ID NO: 8) |

According to preferred embodiments of the present invention, there is provided an isolated polypeptide comprising an amino acid sequence in the table below amino acid sequence comprising a sequence in the table below:

| Protein Name | |
|---|---|
| H61775_P16 | (SEQ ID NO: 9) |
| H61775_P17 | (SEQ ID NO: 10) |

According to preferred embodiments of the present invention, there is provided an isolated polynucleotide comprising a nucleic acid sequence in the table below and/or:

| Transcript Name | |
|---|---|
| HUMCEA_PEA_1_T8 | (SEQ ID NO: 502) |
| HUMCEA_PEA_1_T9 | (SEQ ID NO: 503) |
| HUMCEA_PEA_1_T20 | (SEQ ID NO: 504) |
| HUMCEA_PEA_1_T25 | (SEQ ID NO: 505) |
| HUMCEA_PEA_1_T26 | (SEQ ID NO: 506) | a nucleic acid sequence comprising a sequence in the table below:

| Segment Name | |
|---|---|
| HUMCEA_PEA_1_node_0 | (SEQ ID NO: 507) |
| HUMCEA_PEA_1_node_2 | (SEQ ID NO: 508) |
| HUMCEA_PEA_1_node_11 | (SEQ ID NO: 509) |
| HUMCEA_PEA_1_node_12 | (SEQ ID NO: 510) |
| HUMCEA_PEA_1_node_31 | (SEQ ID NO: 511) |
| HUMCEA_PEA_1_node_36 | (SEQ ID NO: 512) |
| HUMCEA_PEA_1_node_44 | (SEQ ID NO: 513) |
| HUMCEA_PEA_1_node_46 | (SEQ ID NO: 514) |
| HUMCEA_PEA_1_node_63 | (SEQ ID NO: 515) |
| HUMCEA_PEA_1_node_65 | (SEQ ID NO: 516) |
| HUMCEA_PEA_1_node_67 | (SEQ ID NO: 517) |
| HUMCEA_PEA_1_node_3 | (SEQ ID NO: 518) |
| HUMCEA_PEA_1_node_7 | (SEQ ID NO: 519) |
| HUMCEA_PEA_1_node_8 | (SEQ ID NO: 520) |
| HUMCEA_PEA_1_node_9 | (SEQ ID NO: 521) |
| HUMCEA_PEA_1_node_10 | (SEQ ID NO: 522) |
| HUMCEA_PEA_1_node_15 | (SEQ ID NO: 523) |
| HUMCEA_PEA_1_node_16 | (SEQ ID NO: 524) |
| HUMCEA_PEA_1_node_17 | (SEQ ID NO: 525) |
| HUMCEA_PEA_1_node_18 | (SEQ ID NO: 526) |
| HUMCEA_PEA_1_node_19 | (SEQ ID NO: 527) |
| HUMCEA_PEA_1_node_20 | (SEQ ID NO: 528) |
| HUMCEA_PEA_1_node_21 | (SEQ ID NO: 529) |
| HUMCEA_PEA_1_node_22 | (SEQ ID NO: 530) |
| HUMCEA_PEA_1_node_23 | (SEQ ID NO: 531) |
| HUMCEA_PEA_1_node_24 | (SEQ ID NO: 532) |
| HUMCEA_PEA_1_node_27 | (SEQ ID NO: 533) |
| HUMCEA_PEA_1_node_29 | (SEQ ID NO: 534) |
| HUMCEA_PEA_1_node_30 | (SEQ ID NO: 535) |
| HUMCEA_PEA_1_node_33 | (SEQ ID NO: 536) |
| HUMCEA_PEA_1_node_34 | (SEQ ID NO: 537) |
| HUMCEA_PEA_1_node_35 | (SEQ ID NO: 538) |
| HUMCEA_PEA_1_node_45 | (SEQ ID NO: 539) |
| HUMCEA_PEA_1_node_50 | (SEQ ID NO: 540) |
| HUMCEA_PEA_1_node_51 | (SEQ ID NO: 541) |
| HUMCEA_PEA_1_node_56 | (SEQ ID NO: 542) |
| HUMCEA_PEA_1_node_57 | (SEQ ID NO: 543) |
| HUMCEA_PEA_1_node_58 | (SEQ ID NO: 544) |
| HUMCEA_PEA_1_node_60 | (SEQ ID NO: 545) |
| HUMCEA_PEA_1_node_61 | (SEQ ID NO: 546) |
| HUMCEA_PEA_1_node_62 | (SEQ ID NO: 547) |
| HUMCEA_PEA_1_node_64 | (SEQ ID NO: 548) |

According to preferred embodiments of the present invention, there is provided an isolated polypeptide comprising an amino acid sequence in the table below:

| Protein Name | Corresponding Transcript(s) |
|---|---|
| HUMCEA_PEA_1_P4 (SEQ ID NO: 550) | HUMCEA_PEA_1_T8 (SEQ ID NO: 502) |
| HUMCEA_PEA_1_P5 (SEQ ID NO: 551) | HUMCEA_PEA_1_T9 (SEQ ID NO: 503) |
| HUMCEA_PEA_1_P14 (SEQ ID NO: 552) | HUMCEA_PEA_1_T20 (SEQ ID NO: 504) |
| HUMCEA_PEA_1_P19 | HUMCEA_PEA_1_T25 |

-continued

| Protein Name | Corresponding Transcript(s) |
|---|---|
| (SEQ ID NO: 553) | (SEQ ID NO: 505) |
| HUMCEA_PEA_1_P20 (SEQ ID NO: 554) | HUMCEA_PEA_1_T26 (SEQ ID NO: 506) |

According to preferred embodiments of the present invention, there is provided an isolated polynucleotide comprising a nucleic acid sequence in the table below and/or:

| Transcript Name | |
|---|---|
| HUMEDF_PEA_2_T5 | (SEQ ID NO: 555) |
| HUMEDF_PEA_2_T10 | (SEQ ID NO: 556) |
| HUMEDF_PEA_2_T11 | (SEQ ID NO: 557) | a nucleic acid sequence comprising a sequence in the table below:

| Segment Name | |
|---|---|
| HUMEDF_PEA_2_node_6 | (SEQ ID NO: 558) |
| HUMEDF_PEA_2_node_11 | (SEQ ID NO: 559) |
| HUMEDF_PEA_2_node_18 | (SEQ ID NO: 560) |
| HUMEDF_PEA_2_node_19 | (SEQ ID NO: 561) |
| HUMEDF_PEA_2_node_22 | (SEQ ID NO: 562) |
| HUMEDF_PEA_2_node_2 | (SEQ ID NO: 563) |
| HUMEDF_PEA_2_node_8 | (SEQ ID NO: 564) |
| HUMEDF_PEA_2_node_20 | (SEQ ID NO: 565) |

According to preferred embodiments of the present invention, there is provided an isolated polypeptide comprising an amino acid sequence in the table below:

| Protein Name | Corresponding Transcript(s) |
|---|---|
| HUMEDF_PEA_2_P5 (SEQ ID NO: 567) | HUMEDF_PEA_2_T10 (SEQ ID NO: 556) |
| HUMEDF_PEA_2_P6 (SEQ ID NO: 568) | HUMEDF_PEA_2_T11 (SEQ ID NO: 557) |
| HUMEDF_PEA_2_P8 (SEQ ID NO: 569) | HUMEDF_PEA_2_T5 (SEQ ID NO: 555) |

According to preferred embodiments of the present invention, there is provided an isolated polynucleotide comprising a nucleic acid sequence in the table below and/or:

| Transcript Name | |
|---|---|
| HSAPHOL_T10 | (SEQ ID NO: 11) |
| HSAPHOL_T4 | (SEQ ID NO: 12) |
| HSAPHOL_T5 | (SEQ ID NO: 13) |
| HSAPHOL_T6 | (SEQ ID NO: 14) |
| HSAPHOL_T7 | (SEQ ID NO: 15) |
| HSAPHOL_T8 | (SEQ ID NO: 16) |
| HSAPHOL_T9 | (SEQ ID NO: 17) | a nucleic acid sequence comprising a sequence in the table below:

| Segment Name | |
|---|---|
| HSAPHOL_node_11 | (SEQ ID NO: 18) |
| HSAPHOL_node_13 | (SEQ ID NO: 19) |
| HSAPHOL_node_15 | (SEQ ID NO: 20) |
| HSAPHOL_node_19 | (SEQ ID NO: 21) |
| HSAPHOL_node_2 | (SEQ ID NO: 22) |
| HSAPHOL_node_21 | (SEQ ID NO: 23) |
| HSAPHOL_node_23 | (SEQ ID NO: 24) |
| HSAPHOL_node_26 | (SEQ ID NO: 25) |
| HSAPHOL_node_28 | (SEQ ID NO: 26) |
| HSAPHOL_node_38 | (SEQ ID NO: 27) |
| HSAPHOL_node_40 | (SEQ ID NO: 28) |
| HSAPHOL_node_42 | (SEQ ID NO: 29) |
| HSAPHOL_node_16 | (SEQ ID NO: 30) |
| HSAPHOL_node_25 | (SEQ ID NO: 31) |
| HSAPHOL_node_34 | (SEQ ID NO: 32) |
| HSAPHOL_node_35 | (SEQ ID NO: 33) |
| HSAPHOL_node_36 | (SEQ ID NO: 34) |
| HSAPHOL_node_41 | (SEQ ID NO: 35) |

According to preferred embodiments of the present invention, there is provided an isolated polypeptide comprising an amino acid sequence in the table below:

| Protein Name | |
|---|---|
| HSAPHOL_P2 | (SEQ ID NO: 37) |
| HSAPHOL_P3 | (SEQ ID NO: 38) |
| HSAPHOL_P4 | (SEQ ID NO: 39) |
| HSAPHOL_P5 | (SEQ ID NO: 40) |
| HSAPHOL_P6 | (SEQ ID NO: 41) |
| HSAPHOL_P7 | (SEQ ID NO: 42) |
| HSAPHOL_P8 | (SEQ ID NO: 43) |

According to preferred embodiments of the present invention, there is provided an isolated polynucleotide comprising a nucleic acid sequence in the table below and/or:

| Transcript Name | |
|---|---|
| T10888_PEA_1_T1 | (SEQ ID NO: 44) |
| T10888_PEA_1_T4 | (SEQ ID NO: 45) |
| T10888_PEA_1_T5 | (SEQ ID NO: 46) |
| T10888_PEA_1_T6 | (SEQ ID NO: 47) | a nucleic acid sequence comprising a sequence in the table below:

| Segment Name | |
|---|---|
| T10888_PEA_1_node_11 | (SEQ ID NO: 48) |
| T10888_PEA_1_node_12 | (SEQ ID NO: 49) |
| T10888_PEA_1_node_17 | (SEQ ID NO: 50) |
| T10888_PEA_1_node_4 | (SEQ ID NO: 51) |
| T10888_PEA_1_node_6 | (SEQ ID NO: 52) |
| T10888_PEA_1_node_7 | (SEQ ID NO: 53) |
| T10888_PEA_1_node_9 | (SEQ ID NO: 54) |
| T10888_PEA_1_node_15 | (SEQ ID NO: 55) |

According to preferred embodiments of the present invention, there is provided an isolated polypeptide comprising an amino acid sequence in the table below:

| Protein Name | |
|---|---|
| T10888_PEA_1_P2 | (SEQ ID NO: 57) |
| T10888_PEA_1_P4 | (SEQ ID NO: 58) |
| T10888_PEA_1_P5 | (SEQ ID NO: 59) |
| T10888_PEA_1_P6 | (SEQ ID NO: 60) |

According to preferred embodiments of the present invention, there is provided an isolated polynucleotide comprising a nucleic acid sequence in the table below and/or:

| Transcript Name | |
|---|---|
| HSECADH_T11 | (SEQ ID NO: 61) |
| HSECADH_T18 | (SEQ ID NO: 62) |
| HSECADH_T19 | (SEQ ID NO: 63) |
| HSECADH_T20 | (SEQ ID NO: 64) | a nucleic acid sequence comprising a sequence in the table below:

| Segment Name | |
|---|---|
| HSECADH_node_0 | (SEQ ID NO: 65) |
| HSECADH_node_14 | (SEQ ID NO: 66) |
| HSECADH_node_15 | (SEQ ID NO: 67) |
| HSECADH_node_21 | (SEQ ID NO: 68) |
| HSECADH_node_22 | (SEQ ID NO: 69) |
| HSECADH_node_25 | (SEQ ID NO: 70) |
| HSECADH_node_26 | (SEQ ID NO: 71) |
| HSECADH_node_48 | (SEQ ID NO: 72) |
| HSECADH_node_52 | (SEQ ID NO: 73) |
| HSECADH_node_53 | (SEQ ID NO: 74) |
| HSECADH_node_54 | (SEQ ID NO: 75) |
| HSECADH_node_57 | (SEQ ID NO: 76) |
| HSECADH_node_60 | (SEQ ID NO: 77) |
| HSECADH_node_62 | (SEQ ID NO: 78) |
| HSECADH_node_63 | (SEQ ID NO: 79) |
| HSECADH_node_7 | (SEQ ID NO: 80) |
| HSECADH_node_1 | (SEQ ID NO: 81) |
| HSECADH_node_11 | (SEQ ID NO: 82) |
| HSECADH_node_12 | (SEQ ID NO: 83) |
| HSECADH_node_17 | (SEQ ID NO: 84) |
| HSECADH_node_18 | (SEQ ID NO: 85) |
| HSECADH_node_19 | (SEQ ID NO: 86) |
| HSECADH_node_3 | (SEQ ID NO: 87) |
| HSECADH_node_42 | (SEQ ID NO: 88) |
| HSECADH_node_45 | (SEQ ID NO: 89) |
| HSECADH_node_46 | (SEQ ID NO: 90) |
| HSECADH_node_55 | (SEQ ID NO: 91) |
| HSECADH_node_56 | (SEQ ID NO: 92) |
| HSECADH_node_58 | (SEQ ID NO: 93) |
| HSECADH_node_59 | (SEQ ID NO: 94) |

According to preferred embodiments of the present invention, there is provided an isolated polypeptide comprising an amino acid sequence in the table below:

| Protein Name | |
|---|---|
| HSECADH_P9 | (SEQ ID NO: 96) |
| HSECADH_P13 | (SEQ ID NO: 97) |
| HSECADH_P14 | (SEQ ID NO: 98) |
| HSECADH_P15 | (SEQ ID NO: 99) |

According to preferred embodiments of the present invention, there is provided an isolated polynucleotide comprising a nucleic acid sequence in the table below and/or:

| Transcript Name | |
|---|---|
| HUMGRP5E_T4 | (SEQ ID NO: 100) |
| HUMGRP5E_T5 | (SEQ ID NO: 101) | a nucleic acid sequence comprising a sequence in the table below:

| Segment Name | |
|---|---|
| HUMGRP5E_node_0 | (SEQ ID NO: 102) |
| HUMGRP5E_node_2 | (SEQ ID NO: 103) |
| HUMGRP5E_node_8 | (SEQ ID NO: 104) |
| HUMGRP5E_node_3 | (SEQ ID NO: 105) |
| HUMGRP5E_node_7 | (SEQ ID NO: 106) |

According to preferred embodiments of the present invention, there is provided an isolated polypeptide comprising an amino acid sequence in the table below:

| Protein Name | |
|---|---|
| HUMGRP5E_P4 | (SEQ ID NO: 108) |
| HUMGRP5E_P5 | (SEQ ID NO: 109) |

According to preferred embodiments of the present invention, there is provided an isolated polynucleotide comprising a nucleic acid sequence in the table below and/or:

| Transcript Name | |
|---|---|
| R11723_PEA_1_T15 | (SEQ ID NO: 110) |
| R11723_PEA_1_T17 | (SEQ ID NO: 111) |
| R11723_PEA_1_T19 | (SEQ ID NO: 112) |
| R11723_PEA_1_T20 | (SEQ ID NO: 113) |
| R11723_PEA_1_T5 | (SEQ ID NO: 114) |
| R11723_PEA_1_T6 | (SEQ ID NO: 115) | a nucleic acid sequence comprising a sequence in the table below:

| Segment Name | |
|---|---|
| R11723_PEA_1_node_13 | (SEQ ID NO: 116) |
| R11723_PEA_1_node_16 | (SEQ ID NO: 117) |
| R11723_PEA_1_node_19 | (SEQ ID NO: 118) |
| R11723_PEA_1_node_2 | (SEQ ID NO: 119) |
| R11723_PEA_1_node_22 | (SEQ ID NO: 120) |
| R11723_PEA_1_node_31 | (SEQ ID NO: 121) |
| R11723_PEA_1_node_10 | (SEQ ID NO. 122) |
| R11723_PEA_1_node_11 | (SEQ ID NO: 123) |
| R11723_PEA_1_node_15 | (SEQ ID NO: 124) |
| R11723_PEA_1_node_18 | (SEQ ID NO: 125) |
| R11723_PEA_1_node_20 | (SEQ ID NO: 126) |
| R11723_PEA_1_node_21 | (SEQ ID NO: 127) |
| R11723_PEA_1_node_23 | (SEQ ID NO: 128) |
| R11723_PEA_1_node_24 | (SEQ ID NO: 129) |
| R11723_PEA_1_node_25 | (SEQ ID NO: 130) |
| R11723_PEA_1_node_26 | (SEQ ID NO: 131) |
| R11723_PEA_1_node_27 | (SEQ ID NO: 132) |
| R11723_PEA_1_node_28 | (SEQ ID NO: 133) |
| R11723_PEA_1_node_29 | (SEQ ID NO: 134) |
| R11723_PEA_1_node_3 | (SEQ ID NO: 135) |
| R11723_PEA_1_node_30 | (SEQ ID NO: 136) |
| R11723_PEA_1_node_4 | (SEQ ID NO: 137) |
| R11723_PEA_1_node_5 | (SEQ ID NO: 138) |
| R11723_PEA_1_node_6 | (SEQ ID NO: 139) |
| R11723_PEA_1_node_7 | (SEQ ID NO: 140) |
| R11723_PEA_1_node_8 | (SEQ ID NO: 141) |

According to preferred embodiments of the present invention, there is provided an isolated polypeptide comprising an amino acid sequence in the table below:

| Protein Name | |
|---|---|
| R11723_PEA_1_P2 | (SEQ ID NO: 142) |
| R11723_PEA_1_P6 | (SEQ ID NO: 143) |
| R11723_PEA_1_P7 | (SEQ ID NO: 144) |
| R11723_PEA_1_P13 | (SEQ ID NO: 145) |
| R11723_PEA_1_P10 | (SEQ ID NO: 146) |

According to preferred embodiments of the present invention, there is provided an isolated polynucleotide comprising a nucleic acid sequence in the table below and/or:

| Transcript Name | |
|---|---|
| D56406_PEA_1_T3 | (SEQ ID NO: 147) |
| D56406_PEA_1_T6 | (SEQ ID NO: 148) |
| D56406_PEA_1_T7 | (SEQ ID NO: 149) | a nucleic acid sequence comprising a sequence in the table below:

| Segment Name | |
|---|---|
| D56406_PEA_1_node_0 | (SEQ ID NO: 150) |
| D56406_PEA_1_node_13 | (SEQ ID NO: 151) |
| D56406_PEA_1_node_11 | (SEQ ID NO: 152) |
| D56406_PEA_1_node_2 | (SEQ ID NO: 153) |
| D56406_PEA_1_node_3 | (SEQ ID NO: 154) |
| D56406_PEA_1_node_5 | (SEQ ID NO: 155) |
| D56406_PEA_1_node_6 | (SEQ ID NO: 156) |
| D56406_PEA_1_node_7 | (SEQ ID NO: 157) |
| D56406_PEA_1_node_8 | (SEQ ID NO: 158) |
| D56406_PEA_1_node_9 | (SEQ ID NO: 159) |

According to preferred embodiments of the present invention, there is provided an isolated polypeptide comprising an amino acid sequence in the table below:

| Protein Name | |
|---|---|
| D56406_PEA_1_P2 | (SEQ ID NO: 161) |
| D56406_PEA_1_P5 | (SEQ ID NO: 162) |
| D56406_PEA_1_P6 | (SEQ ID NO: 163) |

According to preferred embodiments of the present invention, there is provided an isolated polynucleotide comprising a nucleic acid sequence in the table below and/or:

| Transcript Name | |
|---|---|
| H53393_PEA_1_T10 | (SEQ ID NO: 164) |
| H53393_PEA_1_T11 | (SEQ ID NO: 165) |
| H53393_PEA_1_T3 | (SEQ ID NO: 166) |
| H53393_PEA_1_T9 | (SEQ ID NO: 167) | a nucleic acid sequence comprising a sequence in the table below:

| Segment Name | |
|---|---|
| H53393_PEA_1_node_0 | (SEQ ID NO:168) |
| H53393_PEA_1_node_10 | (SEQ ID NO:169) |
| H53393_PEA_1_node_12 | (SEQ ID NO:170) |
| H53393_PEA_1_node_13 | (SEQ ID NO:171) |
| H53393_PEA_1_node_15 | (SEQ ID NO:172) |
| H53393_PEA_1_node_17 | (SEQ ID NO:173) |
| H53393_PEA_1_node_19 | (SEQ ID NO:174) |
| H53393_PEA_1_node_23 | (SEQ ID NO:175) |
| H53393_PEA_1_node_24 | (SEQ ID NO:176) |
| H53393_PEA_1_node_25 | (SEQ ID NO:177) |
| H53393_PEA_1_node_29 | (SEQ ID NO:178) |
| H53393_PEA_1_node_4 | (SEQ ID NO:179) |
| H53393_PEA_1_node_6 | (SEQ ID NO:180) |
| H53393_PEA_1_node_8 | (SEQ ID NO:181) |
| H53393_PEA_1_node_21 | (SEQ ID NO:182) |
| H53393_PEA_1_node_22 | (SEQ ID NO:183) |

According to preferred embodiments of the present invention, there is provided an isolated polypeptide comprising an amino acid sequence in the table below:

| Protein Name | |
|---|---|
| H53393_PEA_1_P2 | (SEQ ID NO: 185) |
| H53393_PEA_1_P3 | (SEQ ID NO: 186) |
| H53393_PEA_1_P6 | (SEQ ID NO: 187) |

According to preferred embodiments of the present invention, there is provided an isolated polynucleotide comprising a nucleic acid sequence in the table below and/or:

| Transcript Name | |
|---|---|
| HSU40434_PEA_1_T13 | (SEQ ID NO:188) | a nucleic acid sequence comprising a sequence in the table below:

| Segment Name | |
|---|---|
| HSU40434_PEA_1_node_1 | (SEQ ID NO:189) |
| HSU40434_PEA_1_node_16 | (SEQ ID NO:190) |
| HSU40434_PEA_1_node_30 | (SEQ ID NO:191) |
| HSU40434_PEA_1_node_32 | (SEQ ID NO:192) |
| HSU40434_PEA_1_node_57 | (SEQ ID NO:193) |
| HSU40434_PEA_1_node_0 | (SEQ ID NO:194) |
| HSU40434_PEA_1_node_10 | (SEQ ID NO:195) |
| HSU40434_PEA_1_node_13 | (SEQ ID NO:196) |
| HSU40434_PEA_1_node_18 | (SEQ ID NO:197) |
| HSU40434_PEA_1_node_2 | (SEQ ID NO:198) |
| HSU40434_PEA_1_node_20 | (SEQ ID NO:199) |
| HSU40434_PEA_1_node_21 | (SEQ ID NO:200) |
| HSU40434_PEA_1_node_23 | (SEQ ID NO:201) |
| HSU40434_PEA_1_node_24 | (SEQ ID NO:202) |
| HSU40434_PEA_1_node_26 | (SEQ ID NO:203) |
| HSU40434_PEA_1_node_28 | (SEQ ID NO:204) |
| HSU40434_PEA_1_node_3 | (SEQ ID NO:205) |
| HSU40434_PEA_1_node_35 | (SEQ ID NO:206) |
| HSU40434_PEA_1_node_36 | (SEQ ID NO:207) |
| HSU40434_PEA_1_node_37 | (SEQ ID NO:208) |
| HSU40434_PEA_1_node_38 | (SEQ ID NO:209) |
| HSU40434_PEA_1_node_39 | (SEQ ID NO:210) |
| HSU40434_PEA_1_node_40 | (SEQ ID NO:211) |
| HSU40434_PEA_1_node_41 | (SEQ ID NO:212) |
| HSU40434_PEA_1_node_42 | (SEQ ID NO:213) |
| HSU40434_PEA_1_node_43 | (SEQ ID NO:214) |
| HSU40434_PEA_1_node_44 | (SEQ ID NO:215) |
| HSU40434_PEA_1_node_47 | (SEQ ID NO:216) |
| HSU40434_PEA_1_node_48 | (SEQ ID NO:217) |
| HSU40434_PEA_1_node_51 | (SEQ ID NO:218) |
| HSU40434_PEA_1_node_52 | (SEQ ID NO:219) |
| HSU40434_PEA_1_node_53 | (SEQ ID NO:220) |
| HSU40434_PEA_1_node_54 | (SEQ ID NO:221) |
| HSU40434_PEA_1_node_56 | (SEQ ID NO:222) |
| HSU40434_PEA_1_node_7 | (SEQ ID NO:223) |
| HSU40434_PEA_1_node_8 | (SEQ ID NO:224) |

According to preferred embodiments of the present invention, there is provided an isolated polypeptide comprising an amino acid sequence in the table below:

| Protein Name | |
|---|---|
| HSU40434_PEA_1_P12 | (SEQ ID NO:226) |

According to preferred embodiments of the present invention, there is provided an isolated polynucleotide comprising a nucleic acid sequence in the table below and/or:

| Transcript Name | |
|---|---|
| M77904_T11 | (SEQ ID NO:227) |
| M77904_T3 | (SEQ ID NO:228) |
| M77904_T8 | (SEQ ID NO:229) |
| M77904_T9 | (SEQ ID NO:230) | a nucleic acid sequence comprising a sequence in the table below:

| Segment Name | |
|---|---|
| M77904_node_0 | (SEQ ID NO:231) |
| M77904_node_11 | (SEQ ID NO:232) |
| M77904_node_12 | (SEQ ID NO:233) |
| M77904_node_14 | (SEQ ID NO:234) |
| M77904_node_15 | (SEQ ID NO:235) |
| M77904_node_17 | (SEQ ID NO:236) |
| M77904_node_2 | (SEQ ID NO:237) |
| M77904_node_21 | (SEQ ID NO:238) |
| M77904_node_23 | (SEQ ID NO:239) |

-continued

| Segment Name | |
|---|---|
| M77904_node_24 | (SEQ ID NO:240) |
| M77904_node_27 | (SEQ ID NO:241) |
| M77904_node_28 | (SEQ ID NO:242) |
| M77904_node_4 | (SEQ ID NO:243) |
| M77904_node_6 | (SEQ ID NO:244) |
| M77904_node_7 | (SEQ ID NO:245) |
| M77904_node_8 | (SEQ ID NO:246) |
| M77904_node_9 | (SEQ ID NO:247) |
| M77904_node_19 | (SEQ ID NO:248) |
| M77904_node_22 | (SEQ ID NO:249) |
| M77904_node_25 | (SEQ ID NO:250) |
| M77904_node_26 | (SEQ ID NO:251) |

According to preferred embodiments of the present invention, there is provided an isolated polypeptide comprising an amino acid sequence in the table below:

| Protein Name | |
|---|---|
| M77904_P2 | (SEQ ID NO:252) |
| M77904_P4 | (SEQ ID NO:253) |
| M77904_P5 | (SEQ ID NO:254) |
| M77904_P7 | (SEQ ID NO:255) |

According to preferred embodiments of the present invention, there is provided an isolated polynucleotide comprising a nucleic acid sequence in the table below and/or:

| Transcript Name | |
|---|---|
| Z25299_PEA_2_T1 | (SEQ ID NO:256) |
| Z25299_PEA_2_T2 | (SEQ ID NO:257) |
| Z25299_PEA_2_T3 | (SEQ ID NO:258) |
| Z25299_PEA_2_T6 | (SEQ ID NO:259) |
| Z25299_PEA_2_T9 | (SEQ ID NO:260) | a nucleic acid sequence comprising a sequence in the table below:

| Segment Name | |
|---|---|
| Z25299_PEA_2_node_20 | (SEQ ID NO:261) |
| Z25299_PEA_2_node_21 | (SEQ ID NO:262) |
| Z25299_PEA_2_node_23 | (SEQ ID NO:263) |
| Z25299_PEA_2_node_24 | (SEQ ID NO:264) |
| Z25299_PEA_2_node_8 | (SEQ ID NO:265) |
| Z25299_PEA_2_node_12 | (SEQ ID NO:266) |
| Z25299_PEA_2_node_13 | (SEQ ID NO:267) |
| Z25299_PEA_2_node_14 | (SEQ ID NO:268) |
| Z25299_PEA_2_node_17 | (SEQ ID NO:269) |
| Z25299_PEA_2_node_18 | (SEQ ID NO:270) |
| Z25299_PEA_2_node_19 | (SEQ ID NO:271) |

According to preferred embodiments of the present invention, there is provided an isolated polypeptide comprising an amino acid sequence in the table below:

| Protein Name | |
|---|---|
| Z25299_PEA_2_P2 | (SEQ ID NO:273) |
| Z25299_PEA_2_P3 | (SEQ ID NO:274) |
| Z25299_PEA_2_P7 | (SEQ ID NO:275) |
| Z25299_PEA_2_P10 | (SEQ ID NO:276) |

According to preferred embodiments of the present invention, there is provided an isolated polynucleotide comprising a nucleic acid sequence in the table below and/or:

| Transcript Name | |
|---|---|
| T39971_T10 | (SEQ ID NO:570) |
| T39971_T12 | (SEQ ID NO:571) |
| T39971_T16 | (SEQ ID NO:572) |
| T39971_T5 | (SEQ ID NO:573) | a nucleic acid sequence comprising a sequence in the table below:

| Segment Name | |
|---|---|
| T39971_node_0 | (SEQ ID NO:574) |
| T39971_node_18 | (SEQ ID NO:575) |
| T39971_node_21 | (SEQ ID NO:576) |
| T39971_node_22 | (SEQ ID NO:577) |
| T39971_node_23 | (SEQ ID NO:578) |
| T39971_node_31 | (SEQ ID NO:579) |
| T39971_node_33 | (SEQ ID NO:580) |
| T39971_node_7 | (SEQ ID NO:581) |
| T39971_node_1 | (SEQ ID NO:582) |
| T39971_node_10 | (SEQ ID NO:583) |
| T39971_node_11 | (SEQ ID NO:584) |
| T39971_node_12 | (SEQ ID NO:585) |
| T39971_node_15 | (SEQ ID NO:586) |
| T39971_node_16 | (SEQ ID NO:587) |
| T39971_node_17 | (SEQ ID NO:588) |
| T39971_node_26 | (SEQ ID NO:589) |
| T39971_node_27 | (SEQ ID NO:590) |
| T39971_node_28 | (SEQ ID NO:591) |
| T39971_node_29 | (SEQ ID NO:592) |
| T39971_node_3 | (SEQ ID NO:593) |
| T39971_node_30 | (SEQ ID NO:594) |
| T39971_node_34 | (SEQ ID NO:595) |
| T39971_node_35 | (SEQ ID NO:596) |
| T39971_node_36 | (SEQ ID NO:597) |
| T39971_node_4 | (SEQ ID NO:598) |
| T39971_node_5 | (SEQ ID NO:599) |
| T39971_node_8 | (SEQ ID NO:600) |
| T39971_node_9 | (SEQ ID NO:601) |

According to preferred embodiments of the present invention, there is provided an isolated polypeptide comprising an amino acid sequence in the table below:

| Protein Name | |
|---|---|
| T39971_P6 | (SEQ ID NO:603) |
| T39971_P9 | (SEQ ID NO:604) |
| T39971_P11 | (SEQ ID NO:605) |
| T39971_P12 | (SEQ ID NO:606) |

According to preferred embodiments of the present invention, there is provided an isolated polynucleotide comprising a nucleic acid sequence in the table below and/or:

| Transcript Name | |
|---|---|
| Z44808_PEA_1_T11 | (SEQ ID NO:607) |
| Z44808_PEA_1_T4 | (SEQ ID NO:608) |
| Z44808_PEA_1_T5 | (SEQ ID NO:609) |
| Z44808_PEA_1_T8 | (SEQ ID NO:610) |
| Z44808_PEA_1_T9 | (SEQ ID NO:611) | a nucleic acid sequence comprising a sequence in the table below:

| Segment Name | |
|---|---|
| Z44808_PEA_1_node_0 | (SEQ ID NO:612) |
| Z44808_PEA_1_node_16 | (SEQ ID NO:613) |
| Z44808_PEA_1_node_2 | (SEQ ID NO:614) |
| Z44808_PEA_1_node_24 | (SEQ ID NO:615) |
| Z44808_PEA_1_node_32 | (SEQ ID NO:616) |
| Z44808_PEA_1_node_33 | (SEQ ID NO:617) |
| Z44808_PEA_1_node_36 | (SEQ ID NO:618) |
| Z44808_PEA_1_node_37 | (SEQ ID NO:619) |
| Z44808_PEA_1_node_41 | (SEQ ID NO:620) |
| Z44808_PEA_1_node_11 | (SEQ ID NO:621) |
| Z44808_PEA_1_node_13 | (SEQ ID NO:622) |
| Z44808_PEA_1_node_18 | (SEQ ID NO:623) |
| Z44808_PEA_1_node_22 | (SEQ ID NO:624) |
| Z44808_PEA_1_node_26 | (SEQ ID NO:625) |
| Z44808_PEA_1_node_30 | (SEQ ID NO:626) |
| Z44808_PEA_1_node_34 | (SEQ ID NO:627) |
| Z44808_PEA_1_node_35 | (SEQ ID NO:628) |
| Z44808_PEA_1_node_39 | (SEQ ID NO:629) |
| Z44808_PEA_1_node_4 | (SEQ ID NO:630) |
| Z44808_PEA_1_node_6 | (SEQ ID NO:631) |
| Z44808_PEA_1_node_8 | (SEQ ID NO:632) |

According to preferred embodiments of the present invention, there is provided an isolated polypeptide comprising an amino acid sequence in the table below:

| Protein Name | |
|---|---|
| Z44808_PEA_1_P5 | (SEQ ID NO: 634) |
| Z44808_PEA_1_P6 | (SEQ ID NO: 635) |
| Z44808_PEA_1_P7 | (SEQ ID NO: 636) |
| Z44808_PEA_1_P11 | (SEQ ID NO: 637) |

According to preferred embodiments of the present invention, there is provided an isolated polynucleotide comprising a nucleic acid sequence in the table below and/or:

| Transcript Name | |
|---|---|
| S67314_PEA_1_T4 | (SEQ ID NO: 638) |
| S67314_PEA_1_T5 | (SEQ ID NO: 639) |
| S67314_PEA_1_T6 | (SEQ ID NO: 640) |
| S67314_PEA_1_T7 | (SEQ ID NO: 641) | a nucleic acid sequence comprising a sequence in the table below:

| Segment Name | |
|---|---|
| S67314_PEA_1_node_0 | (SEQ ID NO: 642) |
| S67314_PEA_1_node_11 | (SEQ ID NO: 643) |
| S67314_PEA_1_node_13 | (SEQ ID NO: 644) |
| S67314_PEA_1_node_15 | (SEQ ID NO: 645) |
| S67314_PEA_1_node_17 | (SEQ ID NO: 646) |
| S67314_PEA_1_node_4 | (SEQ ID NO: 647) |
| S67314_PEA_1_node_10 | (SEQ ID NO: 648) |
| S67314_PEA_1_node_3 | (SEQ ID NO: 649) |

According to preferred embodiments of the present invention, there is provided an isolated polypeptide comprising an amino acid sequence in the table below:

| Protein Name | |
|---|---|
| S67314_PEA_1_P4 | (SEQ ID NO: 651) |
| S67314_PEA_1_P5 | (SEQ ID NO: 652) |
| S67314_PEA_1_P6 | (SEQ ID NO: 653) |
| S67314_PEA_1_P7 | (SEQ ID NO: 654) |

According to preferred embodiments of the present invention, there is provided an isolated polynucleotide comprising a nucleic acid sequence in the table below and/or:

| Transcript Name | |
|---|---|
| Z39337_PEA_2_PEA_1_T3 | (SEQ ID NO: 655) |
| Z39337_PEA_2_PEA_1_T6 | (SEQ ID NO: 656) |
| Z39337_PEA_2_PEA_1_T12 | (SEQ ID NO: 657) | a nucleic acid sequence comprising a sequence in the table below:

| Segment Name | |
|---|---|
| Z39337_PEA_2_PEA_1_node_2 | (SEQ ID NO: 658) |
| Z39337_PEA_2_PEA_1_node_15 | (SEQ ID NO: 659) |
| Z39337_PEA_2_PEA_1_node_16 | (SEQ ID NO: 660) |
| Z39337_PEA_2_PEA_1_node_18 | (SEQ ID NO: 661) |
| Z39337_PEA_2_PEA_1_node_21 | (SEQ ID NO: 662) |
| Z39337_PEA_2_PEA_1_node_22 | (SEQ ID NO: 663) |
| Z39337_PEA_2_PEA_1_node_3 | (SEQ ID NO: 664) |
| Z39337_PEA_2_PEA_1_node_5 | (SEQ ID NO: 665) |
| Z39337_PEA_2_PEA_1_node_6 | (SEQ ID NO: 666) |
| Z39337_PEA_2_PEA_1_node_10 | (SEQ ID NO: 667) |
| Z39337_PEA_2_PEA_1_node_11 | (SEQ ID NO: 668) |
| Z39337_PEA_2_PEA_1_node_14 | (SEQ ID NO: 669) |

According to preferred embodiments of the present invention, there is provided an isolated polypeptide comprising an amino acid sequence in the table below:

| Protein Name | |
|---|---|
| Z39337_PEA_2_PEA_1_P4 | (SEQ ID NO: 671) |
| Z39337_PEA_2_PEA_1_P9 | (SEQ ID NO: 672) |
| Z39337_PEA_2_PEA_1_P13 | (SEQ ID NO: 673) |

According to preferred embodiments of the present invention, there is provided an isolated polynucleotide comprising a nucleic acid sequence in the table below and/or:

| Transcript Name | |
|---|---|
| HUMPHOSLIP_PEA_2_T6 | (SEQ ID NO: 674) |
| HUMPHOSLIP_PEA_2_T7 | (SEQ ID NO: 675) |
| HUMPHOSLIP_PEA_2_T14 | (SEQ ID NO: 676) |
| HUMPHOSLIP_PEA_2_T16 | (SEQ ID NO: 677) |
| HUMPHOSLIP_PEA_2_T17 | (SEQ ID NO: 678) |
| HUMPHOSLIP_PEA_2_T18 | (SEQ ID NO: 679) |
| HUMPHOSLIP_PEA_2_T19 | (SEQ ID NO: 680) | a nucleic acid sequence comprising a sequence in the table below:

| Segment Name | |
|---|---|
| HUMPHOSLIP_PEA_2_node_0 | (SEQ ID NO: 681) |
| HUMPHOSLIP_PEA_2_node_19 | (SEQ ID NO: 682) |
| HUMPHOSLIP_PEA_2_node_34 | (SEQ ID NO: 683) |
| HUMPHOSLIP_PEA_2_node_68 | (SEQ ID NO: 684) |
| HUMPHOSLIP_PEA_2_node_70 | (SEQ ID NO: 685) |
| HUMPHOSLIP_PEA_2_node_75 | (SEQ ID NO: 686) |
| HUMPHOSLIP_PEA_2_node_2 | (SEQ ID NO: 687) |
| HUMPHOSLIP_PEA_2_node_3 | (SEQ ID NO: 688) |
| HUMPHOSLIP_PEA_2_node_4 | (SEQ ID NO: 689) |
| HUMPHOSLIP_PEA_2_node_6 | (SEQ ID NO: 690) |
| HUMPHOSLIP_PEA_2_node_7 | (SEQ ID NO: 691) |
| HUMPHOSLIP_PEA_2_node_8 | (SEQ ID NO: 692) |
| HUMPHOSLIP_PEA_2_node_9 | (SEQ ID NO: 693) |
| HUMPHOSLIP_PEA_2_node_14 | (SEQ ID NO: 694) |
| HUMPHOSLIP_PEA_2_node_15 | (SEQ ID NO: 695) |
| HUMPHOSLIP_PEA_2_node_16 | (SEQ ID NO: 696) |
| HUMPHOSLIP_PEA_2_node_17 | (SEQ ID NO: 697) |
| HUMPHOSLIP_PEA_2_node_23 | (SEQ ID NO: 698) |
| HUMPHOSLIP_PEA_2_node_24 | (SEQ ID NO: 699) |
| HUMPHOSLIP_PEA_2_node_25 | (SEQ ID NO: 700) |
| HUMPHOSLIP_PEA_2_node_26 | (SEQ ID NO: 701) |
| HUMPHOSLIP_PEA_2_node_29 | (SEQ ID NO: 702) |
| HUMPHOSLIP_PEA_2_node_30 | (SEQ ID NO: 703) |
| HUMPHOSLIP_PEA_2_node_33 | (SEQ ID NO: 704) |
| HUMPHOSLIP_PEA_2_node_36 | (SEQ ID NO: 705) |
| HUMPHOSLIP_PEA_2_node_37 | (SEQ ID NO: 706) |
| HUMPHOSLIP_PEA_2_node_39 | (SEQ ID NO: 707) |
| HUMPHOSLIP_PEA_2_node_40 | (SEQ ID NO: 708) |
| HUMPHOSLIP_PEA_2_node_41 | (SEQ ID NO: 709) |
| HUMPHOSLIP_PEA_2_node_42 | (SEQ ID NO: 710) |
| HUMPHOSLIP_PEA_2_node_44 | (SEQ ID NO: 711) |
| HUMPHOSLIP_PEA_2_node_45 | (SEQ ID NO: 712) |
| HUMPHOSLIP_PEA_2_node_47 | (SEQ ID NO: 713) |
| HUMPHOSLIP_PEA_2_node_51 | (SEQ ID NO: 714) |
| HUMPHOSLIP_PEA_2_node_52 | (SEQ ID NO: 715) |
| HUMPHOSLIP_PEA_2_node_53 | (SEQ ID NO: 716) |
| HUMPHOSLIP_PEA_2_node_54 | (SEQ ID NO: 717) |
| HUMPHOSLIP_PEA_2_node_55 | (SEQ ID NO: 718) |
| HUMPHOSLIP_PEA_2_node_58 | (SEQ ID NO: 719) |
| HUMPHOSLIP_PEA_2_node_59 | (SEQ ID NO: 720) |
| HUMPHOSLIP_PEA_2_node_60 | (SEQ ID NO: 721) |
| HUMPHOSLIP_PEA_2_node_61 | (SEQ ID NO: 722) |
| HUMPHOSLIP_PEA_2_node_62 | (SEQ ID NO: 723) |
| HUMPHOSLIP_PEA_2_node_63 | (SEQ ID NO: 724) |
| HUMPHOSLIP_PEA_2_node_64 | (SEQ ID NO: 725) |
| HUMPHOSLIP_PEA_2_node_65 | (SEQ ID NO: 726) |
| HUMPHOSLIP_PEA_2_node_66 | (SEQ ID NO: 727) |
| HUMPHOSLIP_PEA_2_node_67 | (SEQ ID NO: 728) |
| HUMPHOSLIP_PEA_2_node_69 | (SEQ ID NO: 729) |
| HUMPHOSLIP_PEA_2_node_71 | (SEQ ID NO: 730) |
| HUMPHOSLIP_PEA_2_node_72 | (SEQ ID NO: 731) |
| HUMPHOSLIP_PEA_2_node_73 | (SEQ ID NO: 732) |
| HUMPHOSLIP_PEA_2_node_74 | (SEQ ID NO: 733) |

According to preferred embodiments of the present invention, there is provided an isolated polypeptide comprising an amino acid sequence in the table below:

| Protein Name | |
|---|---|
| HUMPHOSLIP_PEA_2_P10 | (SEQ ID NO: 735) |
| HUMPHOSLIP_PEA_2_P12 | (SEQ ID NO: 736) |
| HUMPHOSLIP_PEA_2_P30 | (SEQ ID NO: 737) |
| HUMPHOSLIP_PEA_2_P31 | (SEQ ID NO: 738) |
| HUMPHOSLIP_PEA_2_P33 | (SEQ ID NO: 739) |
| HUMPHOSLIP_PEA_2_P34 | (SEQ ID NO: 740) |
| HUMPHOSLIP_PEA_2_P35 | (SEQ ID NO: 741) |

According to preferred embodiments of the present invention, there is provided an isolated polynucleotide comprising a nucleic acid sequence in the table below and/or:

| Transcript Name | |
|---|---|
| T59832_T6 | (SEQ ID NO: 742) |
| T59832_T8 | (SEQ ID NO: 743) |
| T59832_T11 | (SEQ ID NO: 744) |
| T59832_T15 | (SEQ ID NO: 745) |
| T59832_T22 | (SEQ ID NO: 746) | a nucleic acid sequence comprising a sequence in the table below:

| Segment Name | |
|---|---|
| T59832_node_1 | (SEQ ID NO: 747) |
| T59832_node_7 | (SEQ ID NO: 748) |
| T59832_node_29 | (SEQ ID NO: 749) |
| T59832_node_39 | (SEQ ID NO: 750) |
| T59832_node_2 | (SEQ ID NO: 751) |
| T59832_node_3 | (SEQ ID NO: 752) |
| T59832_node_4 | (SEQ ID NO: 753) |
| T59832_node_5 | (SEQ ID NO: 754) |
| T59832_node_6 | (SEQ ID NO: 755) |
| T59832_node_8 | (SEQ ID NO: 756) |
| T59832_node_9 | (SEQ ID NO: 757) |
| T59832_node_10 | (SEQ ID NO: 758) |
| T59832_node_11 | (SEQ ID NO: 759) |
| T59832_node_12 | (SEQ ID NO: 760) |
| T59832_node_14 | (SEQ ID NO: 761) |
| T59832_node_16 | (SEQ ID NO: 762) |
| T59832_node_19 | (SEQ ID NO: 763) |
| T59832_node_20 | (SEQ ID NO: 764) |
| T59832_node_25 | (SEQ ID NO: 765) |
| T59832_node_26 | (SEQ ID NO: 766) |
| T59832_node_27 | (SEQ ID NO: 767) |
| T59832_node_28 | (SEQ ID NO: 768) |
| T59832_node_30 | (SEQ ID NO: 769) |
| T59832_node_31 | (SEQ ID NO: 770) |
| T59832_node_32 | (SEQ ID NO: 771) |
| T59832_node_34 | (SEQ ID NO: 772) |
| T59832_node_35 | (SEQ ID NO: 773) |
| T59832_node_36 | (SEQ ID NO: 774) |
| T59832_node_37 | (SEQ ID NO: 775) |
| T59832_node_38 | (SEQ ID NO: 776) |

According to preferred embodiments of the present invention, there is provided an isolated polypeptide comprising an amino acid sequence in the table below:

| Protein Name | |
|---|---|
| T59832_P5 | (SEQ ID NO: 778) |
| T59832_P7 | (SEQ ID NO: 779) |
| T59832_P9 | (SEQ ID NO: 780) |
| T59832_P12 | (SEQ ID NO: 781) |
| T59832_P18 | (SEQ ID NO: 782) |

According to preferred embodiments of the present invention, there is provided an isolated polynucleotide comprising a nucleic acid sequence in the table below and/or:

| Transcript Name | |
|---|---|
| HSCP2_PEA_1_T4 | (SEQ ID NO: 783) |
| HSCP2_PEA_1_T13 | (SEQ ID NO: 784) |
| HSCP2_PEA_1_T19 | (SEQ ID NO: 785) |
| HSCP2_PEA_1_T20 | (SEQ ID NO: 786) |
| HSCP2_PEA_1_T22 | (SEQ ID NO: 787) |
| HSCP2_PEA_1_T23 | (SEQ ID NO: 788) |
| HSCP2_PEA_1_T25 | (SEQ ID NO: 789) |
| HSCP2_PEA_1_T31 | (SEQ ID NO: 790) |
| HSCP2_PEA_1_T33 | (SEQ ID NO: 791) |
| HSCP2_PEA_1_T34 | (SEQ ID NO: 792) |
| HSCP2_PEA_1_T45 | (SEQ ID NO: 793) |
| HSCP2_PEA_1_T50 | (SEQ ID NO: 794) | a nucleic acid sequence comprising a sequence in the table below:

| Segment Name | |
|---|---|
| HSCP2_PEA_1_node_0 | (SEQ ID NO: 795) |
| HSCP2_PEA_1_node_3 | (SEQ ID NO: 796) |
| HSCP2_PEA_1_node_6 | (SEQ ID NO: 797) |
| HSCP2_PEA_1_node_8 | (SEQ ID NO: 798) |
| HSCP2_PEA_1_node_10 | (SEQ ID NO: 799) |
| HSCP2_PEA_1_node_14 | (SEQ ID NO: 800) |
| HSCP2_PEA_1_node_23 | (SEQ ID NO: 801) |
| HSCP2_PEA_1_node_26 | (SEQ ID NO: 802) |
| HSCP2_PEA_1_node_29 | (SEQ ID NO: 803) |
| HSCP2_PEA_1_node_31 | (SEQ ID NO: 804) |
| HSCP2_PEA_1_node_32 | (SEQ ID NO: 805) |
| HSCP2_PEA_1_node_34 | (SEQ ID NO: 806) |
| HSCP2_PEA_1_node_52 | (SEQ ID NO: 807) |
| HSCP2_PEA_1_node_58 | (SEQ ID NO: 808) |
| HSCP2_PEA_1_node_72 | (SEQ ID NO: 809) |
| HSCP2_PEA_1_node_73 | (SEQ ID NO: 810) |
| HSCP2_PEA_1_node_74 | (SEQ ID NO: 811) |
| HSCP2_PEA_1_node_76 | (SEQ ID NO: 812) |
| HSCP2_PEA_1_node_78 | (SEQ ID NO: 813) |
| HSCP2_PEA_1_node_80 | (SEQ ID NO: 814) |
| HSCP2_PEA_1_node_84 | (SEQ ID NO: 815) |
| HSCP2_PEA_1_node_4 | (SEQ ID NO. 816) |
| HSCP2_PEA_1_node_7 | (SEQ ID NO: 817) |
| HSCP2_PEA_1_node_13 | (SEQ ID NO: 818) |
| HSCP2_PEA_1_node_15 | (SEQ ID NO: 819) |
| HSCP2_PEA_1_node_16 | (SEQ ID NO: 820) |
| HSCP2_PEA_1_node_18 | (SEQ ID NO: 821) |
| HSCP2_PEA_1_node_20 | (SEQ ID NO: 822) |
| HSCP2_PEA_1_node_21 | (SEQ ID NO: 823) |
| HSCP2_PEA_1_node_37 | (SEQ ID NO: 824) |
| HSCP2_PEA_1_node_38 | (SEQ ID NO: 825) |
| HSCP2_PEA_1_node_39 | (SEQ TD NO: 826) |
| HSCP2_PEA_1_node_41 | (SEQ ID NO: 827) |
| HSCP2_PEA_1_node_42 | (SEQ ID NO: 828) |
| HSCP2_PEA_1_node_46 | (SEQ ID NO: 829) |
| HSCP2_PEA_1_node_47 | (SEQ ID NO: 830) |
| HSCP2_PEA_1_node_50 | (SEQ ID NO: 831) |
| HSCP2_PEA_1_node_51 | (SEQ ID NO: 832) |

-continued

| Segment Name | |
|---|---|
| HSCP2_PEA_1_node_55 | (SEQ ID NO: 833) |
| HSCP2_PEA_1_node_56 | (SEQ ID NO: 834) |
| HSCP2_PEA_1_node_60 | (SEQ ID NO: 835) |
| HSCP2_PEA_1_node_61 | (SEQ ID NO: 836) |
| HSCP2_PEA_1_node_67 | (SEQ ID NO: 837) |
| HSCP2_PEA_1_node_68 | (SEQ ID NO: 838) |
| HSCP2_PEA_1_node_69 | (SEQ ID NO: 839) |
| HSCP2_PEA_1_node_70 | (SEQ ID NO: 840) |
| HSCP2_PEA_1_node_75 | (SEQ ID NO: 841) |
| HSCP2_PEA_1_node_77 | (SEQ ID NO: 842) |
| HSCP2_PEA_1_node_79 | (SEQ ID NO: 843) |
| HSCP2_PEA_1_node_82 | (SEQ ID NO: 844) |

According to preferred embodiments of the present invention, there is provided an isolated polypeptide comprising an amino acid sequence in the table below:

| Protein Name | |
|---|---|
| HSCP2_PEA_1_P4 | (SEQ ID NO:846) |
| HSCP2_PEA_1_P8 | (SEQ ID NO:847) |
| HSCP2_PEA_1_P14 | (SEQ ID NO:848) |
| HSCP2_PEA_1_P15 | (SEQ ID NO:849) |
| HSCP2_PEA_1_P2 | (SEQ ID NO:850) |
| HSCP2_PEA_1_P16 | (SEQ ID NO:851) |
| HSCP2_PEA_1_P6 | (SEQ ID NO:852) |
| HSCP2_PEA_1_P22 | (SEQ ID NO:853) |
| HSCP2_PEA_1_P24 | (SEQ ID NO:854) |
| HSCP2_PEA_1_P25 | (SEQ ID NO:855) |
| HSCP2_PEA_1_P33 | (SEQ ID NO:856) |

According to preferred embodiments of the present invention, there is provided an isolated polynucleotide comprising a nucleic acid sequence in the table below and/or:

| Transcript Name | |
|---|---|
| HUMTEN_PEA_1_T4 | (SEQ ID NO:857) |
| HUMTEN_PEA_1_T5 | (SEQ ID NO:858) |
| HUMTEN_PEA_1_T6 | (SEQ ID NO:859) |
| HUMTEN_PEA_1_T7 | (SEQ ID NO:860) |
| HUMTEN_PEA_1_T11 | (SEQ ID NO:861) |
| HUMTEN_PEA_1_T14 | (SEQ ID NO:862) |
| HUMTEN_PEA_1_T16 | (SEQ ID NO:863) |
| HUMTEN_PEA_1_T17 | (SEQ ID NO:864) |
| HUMTEN_PEA_1_T18 | (SEQ ID NO:865) |
| HUMTEN_PEA_1_T19 | (SEQ ID NO:866) |
| HUMTEN_PEA_1_T20 | (SEQ ID NO:867) |
| HUMTEN_PEA_1_T23 | (SEQ ID NO:868) |
| HUMTEN_PEA_1_T32 | (SEQ ID NO:869) |
| HUMTEN_PEA_1_T35 | (SEQ ID NO:870) |
| HUMTEN_PEA_1_T36 | (SEQ ID NO:871) |
| HUMTEN_PEA_1_T37 | (SEQ ID NO:872) |
| HUMTEN_PEA_1_T39 | (SEQ ID NO:873) |
| HUMTEN_PEA_1_T40 | (SEQ ID NO:874) |
| HUMTEN_PEA_1_T41 | (SEQ ID NO:875) | a nucleic acid sequence comprising a sequence in the table below:

| Segment Name | |
|---|---|
| HUMTEN_PEA_1_node_0 | (SEQ ID NO:876) |
| HUMTEN_PEA_1_node_2 | (SEQ ID NO:877) |

-continued

| Segment Name | |
|---|---|
| HUMTEN_PEA_1_node_5 | (SEQ ID NO:878) |
| HUMTEN_PEA_1_node_6 | (SEQ ID NO:879) |
| HUMTEN_PEA_1_node_11 | (SEQ ID NO:880) |
| HUMTEN_PEA_1_node_12 | (SEQ ID NO:881) |
| HUMTEN_PEA_1_node_16 | (SEQ ID NO:882) |
| HUMTEN_PEA_1_node_19 | (SEQ ID NO:883) |
| HUMTEN_PEA_1_node_23 | (SEQ ID NO:884) |
| HUMTEN_PEA_1_node_27 | (SEQ ID NO:885) |
| HUMTEN_PEA_1_node_28 | (SEQ ID NO:886) |
| HUMTEN_PEA_1_node_30 | (SEQ ID NO:887) |
| HUMTEN_PEA_1_node_32 | (SEQ ID NO:888) |
| HUMTEN_PEA_1_node_33 | (SEQ ID NO:889) |
| HUMTEN_PEA_1_node_35 | (SEQ ID NO:890) |
| HUMTEN_PEA_1_node_38 | (SEQ ID NO:891) |
| HUMTEN_PEA_1_node_40 | (SEQ ID NO:892) |
| HUMTEN_PEA_1_node_42 | (SEQ ID NO:893) |
| HUMTEN_PEA_1_node_43 | (SEQ ID NO:894) |
| HUMTEN_PEA_1_node_44 | (SEQ ID NO:895) |
| HUMTEN_PEA_1_node_45 | (SEQ ID NO:896) |
| HUMTEN_PEA_1_node_46 | (SEQ ID NO:897) |
| HUMTEN_PEA_1_node_47 | (SEQ ID NO:898) |
| HUMTEN_PEA_1_node_49 | (SEQ ID NO:899) |
| HUMTEN_PEA_1_node_51 | (SEQ ID NO:900) |
| HUMTEN_PEA_1_node_56 | (SEQ ID NO:901) |
| HUMTEN_PEA_1_node_65 | (SEQ ID NO:902) |
| HUMTEN_PEA_1_node_71 | (SEQ ID NO:903) |
| HUMTEN_PEA_1_node_73 | (SEQ ID NO:904) |
| HUMTEN_PEA_1_node_76 | (SEQ ID NO:905) |
| HUMTEN_PEA_1_node_79 | (SEQ ID NO:906) |
| HUMTEN_PEA_1_node_83 | (SEQ ID NO:907) |
| HUMTEN_PEA_1_node_89 | (SEQ ID NO:908) |
| HUMTEN_PEA_1_node_7 | (SEQ ID NO:909) |
| HUMTEN_PEA_1_node_8 | (SEQ ID NO:910) |
| HUMTEN_PEA_1_node_9 | (SEQ ID NO:911) |
| HUMTEN_PEA_1_node_14 | (SEQ ID NO:912) |
| HUMTEN_PEA_1_node_17 | (SEQ ID NO:913) |
| HUMTEN_PEA_1_node_21 | (SEQ ID NO:914) |
| HUMTEN_PEA_1_node_22 | (SEQ ID NO:915) |
| HUMTEN_PEA_1_node_25 | (SEQ ID NO:916) |
| HUMTEN_PEA_1_node_36 | (SEQ ID NO:917) |
| HUMTEN_PEA_1_node_53 | (SEQ ID NO:918) |
| HUMTEN_PEA_1_node_54 | (SEQ ID NO:919)) |
| HUMTEN_PEA_1_node_57 | (SEQ ID NO:920) |
| HUMTEN_PEA_1_node_61 | (SEQ ID NO:921) |
| HUMTEN_PEA_1_node_62 | (SEQ ID NO:922) |
| HUMTEN_PEA_1_node_67 | (SEQ ID NO:923) |
| HUMTEN_PEA_1_node_68 | (SEQ ID NO:924) |
| HUMTEN_PEA_1_node_69 | (SEQ ID NO:925) |
| HUMTEN_PEA_1_node_70 | (SEQ ID NO:926) |
| HUMTEN_PEA_1_node_72 | (SEQ ID NO:927) |
| HUMTEN_PEA_1_node_84 | (SEQ ID NO:928) |
| HUMTEN_PEA_1_node_85 | (SEQ ID NO:929) |
| HUMTEN_PEA_1_node_86 | (SEQ ID NO:930) |
| HUMTEN_PEA_1_node_87 | (SEQ ID NO:931) |
| HUMTEN_PEA_1_node_88 | (SEQ ID NO:932) |

According to preferred embodiments of the present invention, there is provided an isolated polypeptide comprising an amino acid sequence in the table below:

| Protein Name | |
|---|---|
| HUMTEN_PEA_1_P5 | (SEQ ID NO:934) |
| HUMTEN_PEA_1_P6 | (SEQ ID NO:935) |
| HUMTEN_PEA_1_P7 | (SEQ ID NO:936) |
| HUMTEN_PEA_1_P8 | (SEQ ID NO:937) |
| HUMTEN_PEA_1_P10 | (SEQ ID NO:938) |
| HUMTEN_PEA_1_P11 | (SEQ ID NO:939) |
| HUMTEN_PEA_1_P13 | (SEQ ID NO:940) |
| HUMTEN_PEA_1_P14 | (SEQ ID NO:941) |
| HUMTEN_PEA_1_P15 | (SEQ ID NO:942) |
| HUMTEN_PEA_1_P16 | (SEQ ID NO:943) |
| HUMTEN_PEA_1_P17 | (SEQ ID NO:944) |

-continued

| Protein Name | |
|---|---|
| HUMTEN_PEA_1_P20 | (SEQ ID NO:945) |
| HUMTEN_PEA_1_P26 | (SEQ ID NO:946) |
| HUMTEN_PEA_1_P27 | (SEQ ID NO:947) |
| HUMTEN_PEA_1_P28 | (SEQ ID NO:948) |
| HUMTEN_PEA_1_P29 | (SEQ ID NO:949) |
| HUMTEN_PEA_1_P30 | (SEQ ID NO:950) |
| HUMTEN_PEA_1_P31 | (SEQ ID NO:951) |
| HUMTEN_PEA_1_P32 | (SEQ ID NO:952) |

According to preferred embodiments of the present invention, there is provided an isolated polynucleotide comprising a nucleic acid sequence in the table below and/or:

| Transcript Name | |
|---|---|
| HUMOSTRO_PEA_1_PEA_1_T14 | (SEQ ID NO:277) |
| HUMOSTRO_PEA_1_PEA_1_T16 | (SEQ ID NO:278) |
| HUMOSTRO_PEA_1_PEA_1_T30 | (SEQ ID NO:279) | a nucleic acid sequence comprising a sequence in the table below:

| Segment Name | |
|---|---|
| HUMOSTRO_PEA_1_PEA_1_node_0 | (SEQ ID NO:280) |
| HUMOSTRO_PEA_1_PEA_1_node_10 | (SEQ ID NO:281) |
| HUMOSTRO_PEA_1_PEA_1_node_16 | (SEQ ID NO:282) |
| HUMOSTRO_PEA_1_PEA_1_node_23 | (SEQ ID NO:283) |
| HUMOSTRO_PEA_1_PEA_1_node_31 | (SEQ ID NO:284) |
| HUMOSTRO_PEA_1_PEA_1_node_43 | (SEQ ID NO:285) |
| HUMOSTRO_PEA_1_PEA_1_node_3 | (SEQ ID NO:286) |
| HUMOSTRO_PEA_1_PEA_1_node_5 | (SEQ ID NO:287) |
| HUMOSTRO_PEA_1_PEA_1_node_7 | (SEQ ID NO:288) |
| HUMOSTRO_PEA_1_PEA_1_node_8 | (SEQ ID NO:289) |
| HUMOSTRO_PEA_1_PEA_1_node_15 | (SEQ ID NO:290) |
| HUMOSTRO_PEA_1_PEA_1_node_17 | (SEQ ID NO:291) |
| HUMOSTRO_PEA_1_PEA_1_node_20 | (SEQ ID NO:292) |
| HUMOSTRO_PEA_1_PEA_1_node_21 | (SEQ ID NO:293) |
| HUMOSTRO_PEA_1_PEA_1_node_22 | (SEQ ID NO:294) |
| HUMOSTRO_PEA_1_PEA_1_node_24 | (SEQ ID NO:295) |
| HUMOSTRO_PEA_1_PEA_1_node_26 | (SEQ ID NO:296) |
| HUMOSTRO_PEA_1_PEA_1_node_27 | (SEQ ID NO:297) |
| HUMOSTRO_PEA_1_PEA_1_node_28 | (SEQ ID NO:298) |
| HUMOSTRO_PEA_1_PEA_1_node_29 | (SEQ ID NO:299) |
| HUMOSTRO_PEA_1_PEA_1_node_30 | (SEQ ID NO:300) |
| HUMOSTRO_PEA_1_PEA_1_node_32 | (SEQ ID NO:301) |
| HUMOSTRO_PEA_1_PEA_1_node_34 | (SEQ ID NO:302) |
| HUMOSTRO_PEA_1_PEA_1_node_36 | (SEQ ID NO:303) |
| HUMOSTRO_PEA_1_PEA_1_node_37 | (SEQ ID NO:304) |
| HUMOSTRO_PEA_1_PEA_1_node_38 | (SEQ ID NO:305) |
| HUMOSTRO_PEA_1_PEA_1_node_39 | (SEQ ID NO:306) |
| HUMOSTRO_PEA_1_PEA_1_node_40 | (SEQ ID NO:307) |
| HUMOSTRO_PEA_1_PEA_1_node_41 | (SEQ ID NO:308) |
| HUMOSTRO_PEA_1_PEA_1_node_42 | (SEQ ID NO:309) |

According to preferred embodiments of the present invention, there is provided an isolated polypeptide comprising an amino acid sequence in the table below:

| Protein Name | |
|---|---|
| HUMOSTRO_PEA_1_PEA_1_P21 | (SEQ ID NO:311) |
| HUMOSTRO_PEA_1_PEA_1_P25 | (SEQ ID NO:312) |
| HUMOSTRO_PEA_1_PEA_1_P30 | (SEQ ID NO:313) |

According to preferred embodiments of the present invention, there is provided an isolated polynucleotide comprising a nucleic acid sequence in the table below and/or:

| Transcript Name | |
|---|---|
| T46984_PEA_1_T2 | (SEQ ID NO:314) |
| T46984_PEA_1_T3 | (SEQ ID NO:315) |
| T46984_PEA_1_T12 | (SEQ ID NO:316) |
| T46984_PEA_1_T13 | (SEQ ID NO:317) |
| T46984_PEA_1_T14 | (SEQ ID NO:318) |
| T46984_PEA_1_T15 | (SEQ ID NO:319) |
| T46984_PEA_1_T19 | (SEQ ID NO:320) |
| T46984_PEA_1_T23 | (SEQ ID NO:321) |
| T46984_PEA_1_T27 | (SEQ ID NO:322) |
| T46984_PEA_1_T32 | (SEQ ID NO:323) |
| T46984_PEA_1_T34 | (SEQ ID NO:324) |
| T46984_PEA_1_T35 | (SEQ ID NO:325) |
| T46984_PEA_1_T40 | (SEQ ID NO:326) |
| T46984_PEA_1_T42 | (SEQ ID NO:327) |
| T46984_PEA_1_T43 | (SEQ ID NO:328) |
| T46984_PEA_1_T46 | (SEQ ID NO:329) |
| T46984_PEA_1_T47 | (SEQ ID NO:330) |
| T46984_PEA_1_T48 | (SEQ ID NO:331) |
| T46984_PEA_1_T51 | (SEQ ID NO:332) |
| T46984_PEA_1_T52 | (SEQ ID NO:333) |
| T46984_PEA_1_T54 | (SEQ ID NO:334) | a nucleic acid sequence comprising a sequence in the table below:

| Segment Name | |
|---|---|
| T46984_PEA_1_node_2 | (SEQ ID NO:335) |
| T46984_PEA_1_node_4 | (SEQ ID NO:336) |
| T46984_PEA_1_node_6 | (SEQ ID NO:337) |
| T46984_PEA_1_node_12 | (SEQ TD NO:338) |
| T46984_PEA_1_node_14 | (SEQ ID NO:339) |
| T46984_PEA_1_node_25 | (SEQ ID NO:340) |
| T46984_PEA_1_node_29 | (SEQ ID NO:341) |
| T46984_PEA_1_node_34 | (SEQ ID NO:342) |
| T46984_PEA_1_node_46 | (SEQ ID NO:343) |
| T46984_PEA_1_node_47 | (SEQ ID NO:344) |
| T46984_PEA_1_node_52 | (SEQ ID NO:345) |
| T46984_PEA_1_node_65 | (SEQ ID NO:346) |
| T46984_PEA_1_node_69 | (SEQ ID NO:347) |
| T46984_PEA_1_node_75 | (SEQ ID NO:348) |
| T46984_PEA_1_node_86 | (SEQ ID NO:349) |
| T46984_PEA_1_node_9 | (SEQ ID NO:350) |
| T46984_PEA_1_node_13 | (SEQ ID NO:351) |
| T46984_PEA_1_node_19 | (SEQ ID NO:352) |
| T46984_PEA_1_node_21 | (SEQ ID NO:353) |
| T46984_PEA_1_node_22 | (SEQ ID NO:354) |
| T46984_PEA_1_node_26 | (SEQ ID NO:355) |
| T46984_PEA_1_node_28 | (SEQ ID NO.356) |
| T46984_PEA_1_node_31 | (SEQ ID NO:357) |
| T46984_PEA_1_node_32 | (SEQ TD NO:358) |
| T46984_PEA_1_node_38 | (SEQ ID NO:359) |
| T46984_PEA_1_node_39 | (SEQ ID NO:360) |
| T46984_PEA_1_node_40 | (SEQ ID NO:361) |
| T46984_PEA_1_node_42 | (SEQ ID NO:362) |
| T46984_PEA_1_node_43 | (SEQ ID NO:363) |
| T46984_PEA_1_node_48 | (SEQ ID NO:364) |
| T46984_PEA_1_node_49 | (SEQ ID NO:365) |

-continued

| Segment Name | |
|---|---|
| T46984_PEA_1_node_50 | (SEQ ID NO:366) |
| T46984_PEA_1_node_51 | (SEQ ID NO:367) |
| T46984_PEA_1_node_53 | (SEQ ID NO:368) |
| T46984_PEA_1_node_54 | (SEQ ID NO:369) |
| T46984_PEA_1_node_55 | (SEQ ID NO:370) |
| T46984_PEA_1_node_57 | (SEQ ID NO:371) |
| T46984_PEA_1_node_60 | (SEQ ID NO:372) |
| T46984_PEA_1_node_62 | (SEQ ID NO:373) |
| T46984_PEA_1_node_66 | (SEQ ID NO:374) |
| T46984_PEA_1_node_67 | (SEQ ID NO:375) |
| T46984_PEA_1_node_70 | (SEQ ID NO:376) |
| T46984_PEA_1_node_71 | (SEQ ID NO:377) |
| T46984_PEA_1_node_72 | (SEQ ID NO.378) |
| T46984_PEA_1_node_73 | (SEQ ID NO:379) |
| T46984_PEA_1_node_74 | (SEQ ID NO:380) |
| T46984_PEA_1_node_83 | (SEQ ID NO:381) |
| T46984_PEA_1_node_84 | (SEQ ID NO:382) |
| T46984_PEA_1_node_85 | (SEQ ID NO:383) |

According to preferred embodiments of the present invention, there is provided an isolated polypeptide comprising an amino acid sequence in the table below:

| Protein Name | |
|---|---|
| T46984_PEA_1_P2 | (SEQ ID NO:385) |
| T46984_PEA_1_P3 | (SEQ ID NO:386) |
| T46984_PEA_1_P10 | (SEQ ID NO:387) |
| T46984_PEA_1_P11 | (SEQ ID NO:388) |
| T46984_PEA_1_P12 | (SEQ ID NO:389) |
| T46984_PEA_1_P21 | (SEQ ID NO:390) |
| T46984_PEA_1_P27 | (SEQ ID NO:391) |
| T46984_PEA_1_P32 | (SEQ ID NO:392) |
| T46984_PEA_1_P34 | (SEQ ID NO:393) |
| T46984_PEA_1_P35 | (SEQ ID NO:394) |
| T46984_PEA_1_P38 | (SEQ ID NO:395) |
| T46984_PEA_1_P39 | (SEQ ID NO.396) |
| T46984_PEA_1_P45 | (SEQ ID NO:397) |
| T46984_PEA_1_P46 | (SEQ ID NO:398) |

According to preferred embodiments of the present invention, there is provided an isolated polynucleotide comprising a nucleic acid sequence in the table below and/or:

| Transcript Name | |
|---|---|
| M78530_PEA_1_T11 | (SEQ ID NO:399) |
| M78530_PEA_1_T12 | (SEQ ID NO:400) |
| M78530_PEA_1_T13 | (SEQ ID NO:401) | a nucleic acid sequence comprising a sequence in the table below:

| Segment Name | |
|---|---|
| M78530_PEA_1_node_0 | (SEQ ID NO:402) |
| M78530_PEA_1_node_15 | (SEQ ID NO:403) |
| M78530_PEA_1_node_16 | (SEQ ID NO:404) |
| M78530_PEA_1_node_19 | (SEQ ID NO:405) |
| M78530_PEA_1_node_21 | (SEQ ID NO:406) |
| M78530_PEA_1_node_23 | (SEQ ID NO:407) |
| M78530_PEA_1_node_27 | (SEQ ID NO:408) |
| M78530_PEA_1_node_29 | (SEQ ID NO:409) |
| M78530_PEA_1_node_36 | (SEQ ID NO:410) |

-continued

| Segment Name | |
|---|---|
| M78530_PEA_1_node_37 | (SEQ ID NO:411) |
| M78530_PEA_1_node_2 | (SEQ ID NO:412) |
| M78530_PEA_1_node_4 | (SEQ ID NO:413) |
| M78530_PEA_1_node_5 | (SEQ ID NO:414) |
| M78530_PEA_1_node_7 | (SEQ ID NO:415) |
| M78530_PEA_1_node_9 | (SEQ ID NO:416) |
| M78530_PEA_1_node_10 | (SEQ ID NO:417) |
| M78530_PEA_1_node_18 | (SEQ ID NO:418) |
| M78530_PEA_1_node_25 | (SEQ ID NO:419) |
| M78530_PEA_1_node_30 | (SEQ ID NO:420) |
| M78530_PEA_1_node_33 | (SEQ ID NO:421) |
| M78530_PEA_1_node_34 | (SEQ ID NO:422) |

According to preferred embodiments of the present invention, there is provided an isolated polypeptide comprising an amino acid sequence in the table below:

| Protein Name | |
|---|---|
| M78530_PEA_1_P15 | (SEQ ID NO:426) |
| M78530_PEA_1_P16 | (SEQ ID NO:427) |
| M78530_PEA_1_P17 | (SEQ ID NO:428) |

According to preferred embodiments of the present invention, there is provided an isolated polynucleotide comprising a nucleic acid sequence in the table below and/or:

| Transcript Name | |
|---|---|
| T48119_T2 | (SEQ ID NO:429) | a nucleic acid sequence comprising a sequence in the table below:

| Segment Name | |
|---|---|
| T48119_node_0 | (SEQ ID NO:430) |
| T48119_node_11 | (SEQ ID NO:431) |
| T48119_node_13 | (SEQ ID NO:432) |
| T48119_node_38 | (SEQ ID NO:433) |
| T48119_node_41 | (SEQ ID NO:434) |
| T48119_node_45 | (SEQ ID NO:435) |
| T48119_node_47 | (SEQ ID NO:436) |
| T48119_node_4 | (SEQ ID NO:437) |
| T48119_node_8 | (SEQ ID NO:438) |
| T48119_node_15 | (SEQ ID NO:439) |
| T48119_node_17 | (SEQ ID NO:440) |
| T48119_node_20 | (SEQ ID NO:441) |
| T48119_node_22 | (SEQ ID NO:442) |
| T48119_node_26 | (SEQ ID NO:443) |
| T48119_node_28 | (SEQ ID NO:444) |
| T48119_node_31 | (SEQ ID NO:445) |
| T48119_node_32 | (SEQ ID NO:446) |
| T48119_node_33 | (SEQ ID NO:447) |
| T48119_node_44 | (SEQ ID NO:448) |

According to preferred embodiments of the present invention, there is provided an isolated polypeptide comprising an amino acid sequence in the table below:

| Protein Name | |
|---|---|
| T48119_P2 | (SEQ ID NO: 450) |

According to preferred embodiments of the present invention, there is provided an isolated polynucleotide comprising a nucleic acid sequence in the table below and/or:

| Transcript Name | |
|---|---|
| HSMUC1A_PEA_1_T12 | (SEQ ID NO: 451) |
| HSMUC1A_PEA_1_T26 | (SEQ ID NO: 452) |
| HSMUC1A_PEA_1_T28 | (SEQ ID NO: 453) |
| HSMUC1A_PEA_1_T29 | (SEQ ID NO: 454) |
| HSMUC1A_PEA_1_T30 | (SEQ ID NO: 455) |
| HSMUC1A_PEA_1_T31 | (SEQ ID NO: 456) |
| HSMUC1A_PEA_1_T33 | (SEQ ID NO: 457) |
| HSMUC1A_PEA_1_T34 | (SEQ ID NO: 458) |
| HSMUC1A_PEA_1_T35 | (SEQ ID NO: 459) |
| HSMUC1A_PEA_1_T36 | (SEQ ID NO: 460) |
| HSMUC1A_PEA_1_T40 | (SEQ ID NO: 461) |
| HSMUC1A_PEA_1_T42 | (SEQ ID NO: 462) |
| HSMUC1A_PEA_1_T43 | (SEQ ID NO: 463) |
| HSMUC1A_PEA_1_T47 | (SEQ ID NO: 464) | a nucleic acid sequence comprising a sequence in the table below:

| Segment Name | |
|---|---|
| HSMUC1A_PEA_1_node_0 | (SEQ ID NO: 465) |
| HSMUC1A_PEA_1_node_14 | (SEQ ID NO: 466) |
| HSMUC1A_PEA_1_node_24 | (SEQ ID NO: 467) |
| HSMUC1A_PEA_1_node_29 | (SEQ ID NO: 468) |
| HSMUC1A_PEA_1_node_35 | (SEQ ID NO: 469) |
| HSMUC1A_PEA_1_node_38 | (SEQ ID NO: 470) |
| HSMUC1A_PEA_1_node_3 | (SEQ ID NO: 471) |
| HSMUC1A_PEA_1_node_4 | (SEQ ID NO: 472) |
| HSMUC1A_PEA_1_node_5 | (SEQ ID NO: 473) |
| HSMUC1A_PEA_1_node_6 | (SEQ ID NO: 474) |
| HSMUC1A_PEA_1_node_7 | (SEQ ID NO: 475) |
| HSMUC1A_PEA_1_node_17 | (SEQ ID NO: 476) |
| HSMUC1A_PEA_1_node_18 | (SEQ ID NO: 477) |
| HSMUC1A_PEA_1_node_20 | (SEQ ID NO: 478) |
| HSMUC1A_PEA_1_node_21 | (SEQ ID NO: 479) |
| HSMUC1A_PEA_1_node_23 | (SEQ ID NO: 480) |
| HSMUC1A_PEA_1_node_26 | (SEQ ID NO: 481) |
| HSMUC1A_PEA_1_node_27 | (SEQ ID NO: 482) |
| HSMUC1A_PEA_1_node_31 | (SEQ ID NO: 483) |
| HSMUC1A_PEA_1_node_34 | (SEQ ID NO: 484) |
| HSMUC1A_PEA_1_node_36 | (SEQ ID NO: 485) |
| HSMUC1A_PEA_1_node_37 | (SEQ ID NO: 486) |

According to preferred embodiments of the present invention, there is provided an isolated polypeptide comprising an amino acid sequence in the table below:

| Protein Name | |
|---|---|
| HSMUC1A_PEA_1_P25 | (SEQ ID NO: 488) |
| HSMUC1A_PEA_1_P29 | (SEQ ID NO: 489) |
| HSMUC1A_PEA_1_P30 | (SEQ ID NO: 490) |
| HSMUC1A_PEA_1_P32 | (SEQ ID NO: 491) |
| HSMUC1A_PEA_1_P36 | (SEQ ID NO: 492) |
| HSMUC1A_PEA_1_P39 | (SEQ ID NO: 493) |
| HSMUC1A_PEA_1_P45 | (SEQ ID NO: 494) |

-continued

| Protein Name | |
|---|---|
| HSMUC1A_PEA_1_P49 | (SEQ ID NO: 495) |
| HSMUC1A_PEA_1_P52 | (SEQ ID NO: 496) |
| HSMUC1A_PEA_1_P53 | (SEQ ID NO: 497) |
| HSMUC1A_PEA_1_P56 | (SEQ ID NO: 498) |
| HSMUC1A_PEA_1_P58 | (SEQ ID NO: 499) |
| HSMUC1A_PEA_1_P59 | (SEQ ID NO: 500) |
| HSMUC1A_PEA_1_P63 | (SEQ ID NO: 501) |

According to preferred embodiments of the present invention, there is provided an isolated chimeric polypeptide encoding for HSMUC1A_PEA_1_P63 (SEQ ID NO: 501), comprising a first amino acid sequence being at least 90% homologous to MTPGTQSPFFLLLLLTVLTVVTGSGHASSTPGGEKETSATQRSSV corresponding to amino acids 1-45 of MUC1_HUMAN, which also corresponds to amino acids 1-45 of HSMUC1A_PEA_1_P63 (SEQ ID NO: 501), and a second amino acid sequence being at least 70%, optionally at least 80%, preferably at least 85%, more preferably at least 90% and most preferably at least 95% homologous to a polypeptide having the sequence EEEVSADQVSVGASGVLGSFKEARNAPSFLSWSFSMGPSK (SEQ ID NO: 1060) corresponding to amino acids 46-85 of HSMUC1A_PEA_1_P63 (SEQ ID NO: 501), wherein said first amino acid sequence and second amino acid sequence are contiguous and in a sequential order.

According to preferred embodiments of the present invention, there is provided an isolated polypeptide encoding for a tail of HSMUC1A_PEA_1_P63 (SEQ ID NO: 501), comprising a polypeptide being at least 70%, optionally at least about 80%, preferably at least about 85%, more preferably at least about 90% and most preferably at least about 95% homologous to the sequence EEEVSADQVSVGASGVLGSFKEARNAPSFLSWSFSMGPSK (SEQ ID NO: 1060) in HSMUC1A_PEA_1_P63 (SEQ ID NO: 501).

According to preferred embodiments of the present invention, there is provided an isolated chimeric polypeptide encoding for T46984_PEA_1_P2 (SEQ ID NO: 385), comprising a first amino acid sequence being at least 90% homologous to MAPPGSSTVFLLALTIIASTWALTPTHYLTKHDVERLKASLDRPFTNLESAFYSIVGLSSLGAQVPDAKKACTYIRSNLDPSNVD-SLFYAAQASQALSGCEISISNETKDLLLAAVSEDSSVTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVELRVKISTEVGITNVDLSTVD-KDQSIAPKTTRVTYPAKAKGTFIADSHQNFAL FFQLVDVNTGAELTPHQTFVRLHNQKT-GQEVVFVAEPDNKNVYKFELDTSERKIEFDS ASG-TYTLYLIIGDATLKNPILWNV corresponding to amino acids 1-498 of RIB2_HUMAN, which also corresponds to amino acids 1-498 of T46984_PEA_1_P2 (SEQ ID NO: 385), and a second amino acid sequence being at least 70%, optionally at least 80%, preferably at least 85%, more preferably at least 90% and most preferably at least 95% homologous to a polypeptide having the sequence VCA corresponding to amino acids 499-501 of T46984_PEA_1_P2 (SEQ ID NO: 385), wherein said first amino acid sequence and second amino acid sequence are contiguous and in a sequential order.

According to preferred embodiments of the present invention, there is provided an isolated chimeric polypeptide encoding for T46984_PEA_1_P3 (SEQ ID NO: 386), comprising a first amino acid sequence being at least 90% homologous to MAPPGSSTVFLLALTIIASTWALTPTHYLTKHDVERLKASLDRPFTNLESAFYSIVGLSSLGAQVPDAKKACTYIRSNLDPSNVD-SLFYAAQASQALSGCEISISNETKDLLLAAVSEDSSVTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVELRVKISTEVGITNVDLSTVD-KDQSIAPKTTRVTYPAKAKGTFIADSHQNFAL FFQLVDVNTGAELTPHQ corresponding to amino acids 1-433 of RIB2_HUMAN, which also corresponds to amino acids 1-433 of T46984_PEA_1_P3 (SEQ ID NO: 386), and a second amino acid sequence being at least 70%, optionally at least 80%, preferably at least 85%, more preferably at least 90% and most preferably at least 95% homologous to a polypeptide having the sequence ICHIWKLIFLP (SEQ ID NO: 1061) corresponding to amino acids 434-444 of T46984_PEA_1_P3 (SEQ ID NO: 386), wherein said first amino acid sequence and second amino acid sequence are contiguous and in a sequential order.

According to preferred embodiments of the present invention, there is provided an isolated polypeptide encoding for a tail of T46984_PEA_1_P3 (SEQ ID NO: 386), comprising a polypeptide being at least 70%, optionally at least about 80%, preferably at least about 85%, more preferably at least about 90% and most preferably at least about 95% homologous to the sequence ICHIWKLIFLP (SEQ ID NO: 1061) in T46984_PEA_1_P3 (SEQ ID NO: 386).

According to preferred embodiments of the present invention, there is provided an isolated chimeric polypeptide encoding for T46984_PEA_1_P10 (SEQ ID NO: 387), comprising a first amino acid sequence being at least 90% homologous to MAPPGSSTVFLLALTIIASTWALTPTHYLTKHDVERLKASLDRPFTNLESAFYSIVGLSSLGAQVPDAKKACTYIRSNLDPSNVD-SLFYAAQASQALSGCEISISNETKDLLLAAVSEDSSVTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVELRVKISTEVGITNVDLSTVD-KDQSIAPKTTRVTYPAKAKGTFIADSHQNFAL FFQLVDVNTGAELTPHQTFVRLHNQKT-GQEVVFVAEPDNKNVYKFELDTSERKIEFDS ASG-TYTLYLIIGDATLKNPILWNV corresponding to amino acids 1-498 of RIB2_HUMAN, which also corresponds to amino acids 1-498 of T46984_PEA_1_P10 (SEQ ID NO: 387), and a second amino acid sequence being at least 70%, optionally at least 80%, preferably at least 85%, more preferably at least 90% and most preferably at least 95% homologous to a polypeptide having the sequence LMDQK (SEQ ID NO: 1062) corresponding to amino acids 499-503 of T46984_PEA_1_P10 (SEQ ID NO: 387), wherein said first amino acid sequence and second amino acid sequence are contiguous and in a sequential order.

According to preferred embodiments of the present invention, there is provided an isolated polypeptide encoding for a tail of T46984_PEA_1_P10 (SEQ ID NO: 387), comprising a polypeptide being at least 70%, optionally at least about 80%, preferably at least about 85%, more preferably at least about 90% and most preferably at least about 95% homologous to the sequence LMDQK (SEQ ID NO: 1062) in T46984_PEA_1_P10 (SEQ ID NO: 387).

According to preferred embodiments of the present invention, there is provided an isolated chimeric polypeptide encoding for T46984_PEA_1_P11 (SEQ ID NO: 388), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVELRVKISTEVGITNVDLSTVD-KDQSIAPKTTRVTYPAKAKGTFIADSHQNFAL FFQLVDVNTGAELTPHQTFVRLHNQKT-GQEVVFVAEPDNKNVYKFELDTSERKIEFDS ASG-TYTLYLIIGDATLKNPILWNVADVVIKF-PEEEAPSTVLSQNLFTPKQEIQHLFREPEK RPPTVVSNTFTALILSPLLLLFAL-WIRIGANVSNFTFAPSTIIFHLGHAAMLGLMYVYWT QLNMFQTLKYLAILGSVTFLAGNRMLAQQAVKR corresponding to amino acids 1-628 of RIB2_HUMAN, which also corresponds to amino acids 1-628 of T46984_PEA_1_P11 (SEQ ID NO: 388).

According to preferred embodiments of the present invention, there is provided an isolated chimeric polypeptide encoding for T46984_PEA_1_P12 (SEQ ID NO: 389), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMN corresponding to amino acids 1-338 of RIB2_HUMAN, which also corresponds to amino acids 1-338 of T46984_PEA_1_P12 (SEQ ID NO: 389), and a second amino acid sequence being at least 70%, optionally at least 80%, preferably at least 85%, more preferably at least 90% and most preferably at least 95% homologous to a polypeptide having the sequence SQDLH (SEQ ID NO: 1063) corresponding to amino acids 339-343 of T46984_PEA_1_P12 (SEQ ID NO: 389), wherein said first amino acid sequence and second amino acid sequence are contiguous and in a sequential order.

According to preferred embodiments of the present invention, there is provided an isolated polypeptide encoding for a tail of T46984_PEA_1_P12 (SEQ ID NO: 389), comprising a polypeptide being at least 70%, optionally at least about 80%, preferably at least about 85%, more preferably at least about 90% and most preferably at least about 95% homologous to the sequence SQDLH (SEQ ID NO: 1063) in T46984_PEA_1_P12 (SEQ ID NO: 389).

According to preferred embodiments of the present invention, there is provided an isolated chimeric polypeptide encoding for T46984_PEA_1_P21 (SEQ ID NO: 390), comprising a first amino acid sequence being at least 70%, optionally at least 80%, preferably at least 85%, more preferably at least 90% and most preferably at least 95% homologous to a polypeptide having the sequence M corresponding to amino acids 1-1 of T46984_PEA_1_P21 (SEQ ID NO: 390), and a second amino acid sequence being at least 90% homologous to KACTYIRSNLDPSNVD-SLFYAAQASQALSGCEISISNETKDLL-LAAVSEDSSVTQIYHAV AALSGFGLPLASQEALSAL-TARLSKEETVLATVQALQTASHLSQQADLRSIVEEIE DLVA RLDELGGVYLQFEEGLET-TALFVAATYKLMDH-VGTEPSIKEDQVIQLMNAIFSKKNFES LSEAFS-VASAAAVLSHNRYHVPVVVVPEGSASDTHEQAILRL QVTNVLSQPLTQATVKL EHAKSVASRATVLQKTSFT-PVGDVFELNFMNVKFSSGYYD-FLVEVEGDNRYIANTVEL RVKISTEVGITNVDLSTVD-KDQSIAPKTTRVTYPAKAKGTFIADSHQNFALFFQLV DVNT GAELTPHQTFVRLHNQKTGQEVVFVAEP-DNKNVYKFELDTSERKIEFDSASGTYTLYLII GDATLKNPILWNVADVVIKFPEEEAP-STVLSQNLFTPKQEIQHLFREPEKRPPTVVSNTF TALILSPLLLLFALWIRIGANVSNFT-FAPSTIIFHLGHAAMLGLMYVYWTQLNMFQTLKY LAILGSVTFLAGNRMLAQQAVKRTAH corresponding to amino acids 70-631 of RIB2_HUMAN, which also corresponds to amino acids 2-563 of T46984_PEA_1_P21 (SEQ ID NO: 390), wherein said first amino acid sequence and second amino acid sequence are contiguous and in a sequential order.

According to preferred embodiments of the present invention, there is provided an isolated chimeric polypeptide encoding for T46984_PEA_1_P27 (SEQ ID NO: 391), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVELRVKISTEVGITNVDLSTVD-KDQSIAPKTTRVTYPAKAKGTFIADSHQNFA corresponding to amino acids 1-415 of RIB2_HUMAN, which also corresponds to amino acids 1-415 of T46984_PEA_1_P27 (SEQ ID NO: 391), and a second amino acid sequence being at least 70%, optionally at least 80%, preferably at least 85%, more preferably at least 90% and most preferably at least 95% homologous to a polypeptide having the sequence FGSGLVPMSPTSLLLLARLYFTWDM-LLCWDSCMSTGLSSTCSRP (SEQ ID NO: 1064) corresponding to amino acids 416-459 of T46984_PEA_1_P27

(SEQ ID NO: 391), wherein said first amino acid sequence and second amino acid sequence are contiguous and in a sequential order.

According to preferred embodiments of the present invention, there is provided an isolated polypeptide encoding for a tail of T46984_PEA_1_P27 (SEQ ID NO: 391), comprising a polypeptide being at least 70%, optionally at least about 80%, preferably at least about 85%, more preferably at least about 90% and most preferably at least about 95% homologous to the sequence FGSGLVPMSPTSLLLLARLYFTWD-MLLCWDSCMSTGLSSTCSRP (SEQ ID NO: 1064) in T46984_PEA_1_P27 (SEQ ID NO: 391).

According to preferred embodiments of the present invention, there is provided an isolated chimeric polypeptide encoding for T46984_PEA_1_P32 (SEQ ID NO: 392), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVE corresponding to amino acids 1-364 of RIB2_HUMAN, which also corresponds to amino acids 1-364 of T46984_PEA_1_P32 (SEQ ID NO: 392), and a second amino acid sequence being at least 70%, optionally at least 80%, preferably at least 85%, more preferably at least 90% and most preferably at least 95% homologous to a polypeptide having the sequence GQVRWLTPVIPAL-WEAKAGGSPEVRSSILAWPT (SEQ ID NO: 1065) corresponding to amino acids 365-397 of T46984_PEA_1_P32 (SEQ ID NO: 392), wherein said first amino acid sequence and second amino acid sequence are contiguous and in a sequential order.

According to preferred embodiments of the present invention, there is provided an isolated polypeptide encoding for a tail of T46984_PEA_1_P32 (SEQ ID NO: 392), comprising a polypeptide being at least 70%, optionally at least about 80%, preferably at least about 85%, more preferably at least about 90% and most preferably at least about 95% homologous to the sequence GQVRWLTPVIPALWEAKAGGSPE-VRSSILAWPT (SEQ ID NO: 1065) in T46984_PEA_1_P32 (SEQ ID NO: 392).

According to preferred embodiments of the present invention, there is provided an isolated chimeric polypeptide encoding for T46984_PEA_1_P34 (SEQ ID NO: 393), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFTPVG corresponding to amino acids 1-329 of RIB2_HUMAN, which also corresponds to amino acids 1-329 of T46984_PEA_1_P34 (SEQ ID NO: 393).

According to preferred embodiments of the present invention, there is provided an isolated chimeric polypeptide encoding for T46984_PEA_1_P35 (SEQ ID NO: 394), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAI corresponding to amino acids 1-287 of RIB2_HUMAN, which also corresponds to amino acids 1-287 of T46984_PEA_1_P35 (SEQ ID NO: 394), and a second amino acid sequence being at least 70%, optionally at least 80%, preferably at least 85%, more preferably at least 90% and most preferably at least 95% homologous to a polypeptide having the sequence GCWPSRQS-REQHISSRRKMEILKTECQEKESRTIHSMRRKMEKK NFI (SEQ ID NO: 1066) corresponding to amino acids 288-334 of T46984_PEA_1_P35 (SEQ ID NO: 394), wherein said first amino acid sequence and second amino acid sequence are contiguous and in a sequential order.

According to preferred embodiments of the present invention, there is provided an isolated polypeptide encoding for a tail of T46984_PEA_1_P35 (SEQ ID NO: 394), comprising a polypeptide being at least 70%, optionally at least about 80%, preferably at least about 85%, more preferably at least about 90% and most preferably at least about 95% homologous to the sequence GCWPSRQSREQHISSRRKMEILK-TECQEKESRTIHSMRRKMEKKNFI (SEQ ID NO: 1066) in T46984_PEA_1_P35 (SEQ ID NO: 394).

According to preferred embodiments of the present invention, there is provided an isolated chimeric polypeptide encoding for T46984_PEA_1_P38 (SEQ ID NO: 395), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEAL corresponding to amino acids 1-145 of RIB2_HUMAN, which also corresponds to amino acids 1-145 of T46984_PEA_1_P38 (SEQ ID NO: 395), and a second amino acid sequence being at least 70%, optionally at least 80%, preferably at least 85%, more preferably at least 90% and most preferably at least 95% homologous to a polypeptide having the sequence MDPD-WCQCLQLHFCS (SEQ ID NO: 1067) corresponding to amino acids 146-160 of T46984_PEA_1_P38 (SEQ ID NO: 395), wherein said first amino acid sequence and second amino acid sequence are contiguous and in a sequential order.

According to preferred embodiments of the present invention, there is provided an isolated polypeptide encoding for a tail of T46984_PEA_1_P38 (SEQ ID NO: 395), comprising a polypeptide being at least 70%, optionally at least about 80%, preferably at least about 85%, more preferably at least about 90% and most preferably at least about 95% homologous to the sequence MDPDWCQCLQLHFCS (SEQ ID NO: 1067) in T46984_PEA_1_P38 (SEQ ID NO: 395).

According to preferred embodiments of the present invention, there is provided an isolated chimeric polypeptide encoding for T46984_PEA_1_P39 (SEQ ID NO: 396), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVDSLFYAAQASQALSGCEISISNETKDLLLAAVSEDSSVTQIYHAVAALSGFGLPLASQEALSALTARLSKEETVLA corresponding to amino acids 1-160 of RIB2_HUMAN, which also corresponds to amino acids 1-160 of T46984_PEA_1_P39 (SEQ ID NO. 396).

According to preferred embodiments of the present invention, there is provided an isolated chimeric polypeptide encoding for T46984_PEA_1_P45 (SEQ ID NO: 397), comprising a first amino acid sequence being at least 90% homologous to MAPPGSSTVFLLALTIIASTWALTPTHYLTKHDVERLKASLDRPFTNLESAFYSIVGLSSL GAQVPDAKKACTYIRSNLDPSNVDSLFYAAQASQALSGCE corresponding to amino acids 1-101 of RIB2_HUMAN, which also corresponds to amino acids 1-101 of T46984_PEA_1_P45 (SEQ ID NO: 397), and a second amino acid sequence being at least 70%, optionally at least 80%, preferably at least 85%, more preferably at least 90% and most preferably at least 95% homologous to a polypeptide having the sequence NSPGSADSIPPVPAG (SEQ ID NO: 1068) corresponding to amino acids 102-116 of T46984_PEA_1_P45 (SEQ ID NO: 397), wherein said first amino acid sequence and second amino acid sequence are contiguous and in a sequential order.

According to preferred embodiments of the present invention, there is provided an isolated polypeptide encoding for a tail of T46984_PEA_1_P45 (SEQ ID NO: 397), comprising a polypeptide being at least 70%, optionally at least about 80%, preferably at least about 85%, more preferably at least about 90% and most preferably at least about 95% homologous to the sequence NSPGSADSIPPVPAG (SEQ ID NO: 1068) in T46984_PEA_1_P45 (SEQ ID NO: 397).

According to preferred embodiments of the present invention, there is provided an isolated chimeric polypeptide encoding for T46984_PEA_1_P46 (SEQ ID NO: 398), comprising a first amino acid sequence being at least 90% homologous to MAPPQSSTVFLLALTIIASTWALTPTHYLTKHDVERLKASLDRPFTNLESAFYSIVGLSSL GAQVPDAK corresponding to amino acids 1-69 of RIB2_HUMAN, which also corresponds to amino acids 1-69 of T46984_PEA_1_P46 (SEQ ID NO: 398), and a second amino acid sequence being at least 70%, optionally at least 80%, preferably at least 85%, more preferably at least 90% and most preferably at least 95% homologous to a polypeptide having the sequence NSPGSADSIPPVPAG (SEQ ID NO: 1068) corresponding to amino acids 70-84 of T46984_PEA_1_P46 (SEQ ID NO: 398), wherein said first amino acid sequence and second amino acid sequence are contiguous and in a sequential order.

According to preferred embodiments of the present invention, there is provided an isolated polypeptide encoding for a tail of T46984_PEA_1_P46 (SEQ ID NO: 398), comprising a polypeptide being at least 70%, optionally at least about 80%, preferably at least about 85%, more preferably at least about 90% and most preferably at least about 95% homologous to the sequence NSPGSADSIPPVPAG (SEQ ID NO: 1068) in T46984_PEA_1_P46 (SEQ ID NO: 398).

According to preferred embodiments of the present invention, there is provided an isolated chimeric polypeptide encoding for M78530_PEA_1_P15 (SEQ ID NO: 426), comprising a first amino acid sequence being at least 90% homologous to MRLSPAPLKLSRTPALLALALPLAAALAFSDETLDKVPKSEGYCSRILRAQGTRREGYT EFSLRVEGDPDFYKPGTSYRVTLSAAPPSYFRGFTLIALRENREGDKEEDHAGTFQIIDEE ETQFMSNCPVAVTESTPRRRTRIQVFWIAPPAGTGCVILKASIVQKRIIYFQDEGSLTKKL CEQDSTFDGVTDKPILDCCACGTAKYRLTFYGNWSEKTHPKDYPRRANHWSAIIGGSH SKNYVLWEYGGYASEGVKQVAELGSPVKMEEEIRQQSDEVLTVIKAKAQWPAWQPLN VRAAPSAEFSVDRTRHLMSFLTMMGPSPDWNVGLSAEDLCTKECGWVQKVVQDLIPW DAGTDSGVTYESPNKPTIPQEKIRPLTSLDHPQSPFYDPEGGSITQVARVVIERIARKGEQ CNIVPDNVDDIVADLAPEEKDEDDTPETCIYSNWSPWSACSSSTCDKGKRMRQRMLKA QLDLSVPCPDTQDFQPCMGPGCSDEDGSTCTMSEWITWSPCSISCGMGMRSRERYVKQ FPEDGSVCTLPTEE corresponding to amino acids 1-544 of Q9HCB6 (SEQ ID NO: 424), which also corresponds to amino acids 1-544 of M78530_PEA_1_P15 (SEQ ID NO: 426), a bridging amino acid T corresponding to amino acid 545 of M78530_PEA_1_P15 (SEQ ID NO: 426), a second amino acid sequence being at least 90% homologous to EKCTVNEECSPSSCLMTEWGEWDECSATCGMGMKKRHRMIKMNPADGSMCKAETSQ AEKCMMPECHTIPCLLSPWSEWSDCSVTCGKGMRTRQRMLKSLAELGDCNEDLEQVE KCMLPEC corresponding to amino acids 546-665 of Q9HCB6 (SEQ ID NO: 424), which also corresponds to amino acids 546-665 of M78530_PEA_1_P15 (SEQ ID NO: 426), and a third amino acid sequence being at least 70%, optionally at least 80%, preferably at least 85%, more preferably at least 90% and most preferably at least 95% homologous to a polypeptide having the sequence RKSWSSSRPITSMFLSPGSPEPASANTARS (SEQ ID NO: 1070) corresponding to amino acids 666-695 of M78530_PEA_1_P15 (SEQ ID NO: 426), wherein said first amino acid sequence, bridging amino acid, second amino acid sequence and third amino acid sequence are contiguous and in a sequential order.

According to preferred embodiments of the present invention, there is provided an isolated polypeptide encoding for a tail of M78530_PEA_1_P15 (SEQ ID NO: 426), comprising a polypeptide being at least 70%, optionally at least about 80%, preferably at least about 85%, more preferably at least about 90% and most preferably at least about 95% homologous to the sequence RKSWSSSRPITSMFLSPGSPEPASANTARS (SEQ ID NO: 1070) in M78530_PEA_1_P15 (SEQ ID NO: 426).

According to preferred embodiments of the present invention, there is provided an isolated chimeric polypeptide encoding for M78530_PEA_1_P15 (SEQ ID NO: 426), comprising a first amino acid sequence being at least 70%, optionally at least 80%, preferably at least 85%, more preferably at least 90% and most preferably at least 95% homologous to a polypeptide having the sequence MRLSPAPLKLSRTPALLALALPLAAALAFSDETLDKVPKSEGY CSRILRAQGTRREGYT EFSLRVEGDPDFYKPGTSYRVTLS (SEQ ID NO: 1071) corresponding to amino acids 1-83 of M78530_PEA_1_P15 (SEQ ID NO: 426), a second amino acid sequence being at least 90% homologous to AAPPSYFRGFTLIALRENREGDKEEDHAGTFQIIDEEETQFMSNCPVAVTESTPRRRTRIQ VFWIAPPAGTGCVILKASIVQKRIIYFQDEGSLTKKLCEQDSTFDGVTDKPILDC CACGT AKYRLTFYGNWSEKTHPKDYPRRANHWSAIIGGSHSKNYVLWEYGGYASEGVKQVAE LGSPVKMEEEIRQQSDEVLTVIKAKAQWPAWQPLNVRAAPSAEFSVDRTRHLMSFLTM MGPSPDWNVGLSAEDLCTKECGWVQKVVQDLIPWDAGTDSGVTYESPNKPTIPQEKIR PLTSLDHPQSPFYDPEGGSITQVARVVIERIARKGEQCNIVPDNVDDIVADLAPEEKDED DTPETCIYSNWSPWSACSSSTCDKGKRM-RQRMLKAQLDLSVPCPDTQDFQPCMPGCS DEDGSTCTMSEWITWSPCSISCGMGMRSR-ERYVKQFPEDGSVCTLPTEETEKCTVNEEC SPSSCLMTEWGEWDECSATCGMG-MKKRHRMIKMPADGSMCKAETSQAEKCMMPE CHTIPCLLSPWSEWSDCSVTCGKGMR-TRQRMLKSLAELGDCNEDLEQVEKCMLPEC corresponding to amino acids 1-582 of O94862 (SEQ ID NO: 425), which also corresponds to amino acids 84-665 of M78530_PEA__1_P15 (SEQ ID NO: 426), and a third amino acid sequence being at least 70%, optionally at least 80%, preferably at least 85%, more preferably at least 90% and most preferably at least 95% homologous to a polypeptide having the sequence RKSWSSSRPITSMFLSPGSPEPASANTARS (SEQ ID NO: 1070) corresponding to amino acids 666-695 of M78530_PEA__1_P15 (SEQ ID NO: 426), wherein said first amino acid sequence, second amino acid sequence and third amino acid sequence are contiguous and in a sequential order.

According to preferred embodiments of the present invention, there is provided an isolated polypeptide encoding for a head of M78530_PEA__1_P15 (SEQ ID NO: 426), comprising a polypeptide being at least 70%, optionally at least about 80%, preferably at least about 85%, more preferably at least about 90% and most preferably at least about 95% homologous to the sequence MRLSPAPLKLSRTPALLALALPLAAALAFSDETLDKVPKSEGYCSRILRAQGTRREGYT EFSLRVEGDPDFYKPGTSYRVTLS (SEQ ID NO: 1071) of M78530_PEA__1_P15 (SEQ ID NO: 426).

An isolated polypeptide encoding for a tail of M78530_PEA__1_P15 (SEQ ID NO: 426), comprising a polypeptide being at least 70%, optionally at least about 80%, preferably at least about 85%, more preferably at least about 90% and most preferably at least about 95% homologous to the sequence RKSWSSSRPITSMFLSPGSPEPASANTARS (SEQ ID NO: 1070) in M78530_PEA__1_P15 (SEQ ID NO: 426).

According to preferred embodiments of the present invention, there is provided an isolated chimeric polypeptide encoding for M78530_PEA__1_P16 (SEQ ID NO: 427), comprising a first amino acid sequence being at least 90% homologous to MRLSPAPLKLSRTPALLALALPLAAALAFSDETLDKVPKSEGYCSRIL-RAQGTRREGYT EFSLRVEGDPDFYKPGTSYRVTL-SAAPPSYFRGFTLIALRENREGDKEEDHAGTFQIIDEE ETQFMSNCPVAVTESTPRRRTRIQVF-WIAPPAGTGCVILKASIVQKRIIYFQDEGSLTKKL CEQDSTFDGVTDKPILDCCACGTAKYR-LTFYGNWSEKTHPKDYPRRANHWSAIIGGSH SKNYVLWEYGGYASEGVKQVAELGSPVK-MEEEIRQQSDEVLTVIKAKAQWPAWQPLN V corresponding to amino acids 1-297 of Q8NCD7 (SEQ ID NO: 423), which also corresponds to amino acids 1-297 of M78530_PEA__1_P16 (SEQ ID NO: 427).

According to preferred embodiments of the present invention, there is provided an isolated chimeric polypeptide encoding for M78530_PEA__1_P16 (SEQ ID NO: 427), comprising a first amino acid sequence being at least 90% homologous to MRLSPAPLKLSRTPALLALALPLAAALAFSDETLDKVPKSEGYCSRIL-RAQGTRREGYT EFSLRVEGDPDFYKPGTSYRVTL-SAAPPSYFRGFTLIALRENREGDKEEDHAGTFQIIDEE ETQFMSNCPVAVTESTPRRRTRIQVF-WIAPPAGTGCVILKASIVQKRIIYFQDEGSLTKKL CEQDSTFDGVTDKPILDCCACGTAKYR-LTFYGNWSEKTHPKDYPRRANHWSAIIGGSH SKNYVLWEYGGYASEGVKQVAELGSPVK-MEEEIRQQSDEVLTVIKAKAQWPAWQPLN V corresponding to amino acids 1-297 of Q9HCB6 (SEQ ID NO: 424), which also corresponds to amino acids 1-297 of M78530_PEA__1_P16 (SEQ ID NO: 427).

According to preferred embodiments of the present invention, there is provided an isolated chimeric polypeptide encoding for M78530_PEA__1_P16 (SEQ ID NO: 427), comprising a first amino acid sequence being at least 70%, optionally at least 80%, preferably at least 85%, more preferably at least 90% and most preferably at least 95% homologous to a polypeptide having the sequence MRLSPAPLKLSRTPALLALALPLAAALAFSDETLDKVPKSEG YCSRILRAQGTRREGYT EFSLRVEGDPDFYKPGTSYRVTLS (SEQ ID NO: 1071) corresponding to amino acids 1-83 of M78530_PEA__1_P16 (SEQ ID NO: 427), and a second amino acid sequence being at least 90% homologous to AAPPSYFRGFTLIALRENREGD-KEEDHAGTFQIIDEEETQFM-SNCPVAVTESTPRRRTRIQ VFWIAPPAGTGCVILKA-SIVQKRIIYFQDEGSLTKKLCEQDSTFDGVTDKPILD CCACGT AKYRLTFYGNWSEKTHPKDYPRRANHW-SAIIGGSHSKNYVLWEYGGYASEGVKQVAE LGSPVKMEEEIRQQSDEVLTVIKAKAQWPAWQPLNV corresponding to amino acids 1-214 of O94862 (SEQ ID NO: 425), which also corresponds to amino acids 84-297 of M78530_PEA__1_P16 (SEQ ID NO: 427), wherein said first amino acid sequence and second amino acid sequence are contiguous and in a sequential order.

According to preferred embodiments of the present invention, there is provided an isolated polypeptide encoding for a head of M78530_PEA__1_P16 (SEQ ID NO: 427), comprising a polypeptide being at least 70%, optionally at least about 80%, preferably at least about 85%, more preferably at least about 90% and most preferably at least about 95% homologous to the sequence MRLSPAPLKLSRTPALLALALPLAAALAFSDETLDKVPKSEGYCSRIL-RAQGTRREGYT EFSLRVEGDPDFYKPGTSYRVTLS (SEQ ID NO: 1071) of M78530_PEA__1_P16 (SEQ ID NO: 427).

According to preferred embodiments of the present invention, there is provided an isolated chimeric polypeptide encoding for M78530_PEA__1_P17 (SEQ ID NO: 428), comprising a first amino acid sequence being at least 90% homologous to MRLSPAPLKLSRTPALLALALPLAAALAFSDETLDKVPKSEGYCSRIL-RAQGTRREGYT EFSLRVEGDPDFYKPGTSYRVTL-SAAPPSYFRGFTLIALRENREGDKEEDHAGTFQIIDEE ETQFMSNCPVAVTESTPRRRTRIQVF-WIAPPAGTGCVILKASIVQKRIIYFQDEGSLTKKL CEQDSTFDGVTDKPILDCCACGTAKYR-LTFYGNWSEKTHPKDYPRRANHWSAIIGGSH SKNYVLWEYGGYASEGVKQVAELGSPVK-MEEEIRQQ corresponding to amino acids 1-275 of Q8NCD7 (SEQ ID NO: 423), which also corresponds to amino acids 1-275 of M78530_PEA__1_P17 (SEQ ID NO: 428), and a second amino acid sequence being at least 70%, optionally at least 80%, preferably at least 85%, more preferably at least 90% and most preferably at least 95% homologous to a polypeptide having the sequence VRQKNHRMTK (SEQ ID NO: 1073) corresponding to amino acids 276-285 of M78530_PEA__1_P17 (SEQ ID NO: 428), wherein said first amino acid sequence and second amino acid sequence are contiguous and in a sequential order.

According to preferred embodiments of the present invention, there is provided an isolated polypeptide encoding for a tail of M78530_PEA_1_P17 (SEQ ID NO: 428), comprising a polypeptide being at least 70%, optionally at least about 80%, preferably at least about 85%, more preferably at least about 90% and most preferably at least about 95% homologous to the sequence VRQKNHRMTK (SEQ ID NO: 1073) in M78530_PEA_1_P17 (SEQ ID NO: 428).

According to preferred embodiments of the present invention, there is provided an isolated chimeric polypeptide encoding for M78530_PEA_1_P17 (SEQ ID NO: 428), comprising a first amino acid sequence being at least 90% homologous to MRLSPAPLKLSRTPALLALALPLAAALAFSDETLDKVPKSEGYCSRILRAQGTRREGYT EFSLRVEGDPDFYKPGTSYRVTLSAAPPSYFRGFTLIALRENREGDKEEDHAGTFQIIDEEETQFMSNCPVAVTESTPRRRTRIQVF-WIAPPAGTGCVILKASIVQKRIIYFQDEGSLTKKLCEQDSTFDGVTDKPILDCCACGTAKYR-LTFYGNWSEKTHPKDYPRRANHWSAIIGGSH SKNYVLWEYGGYASEGVKQVAELGSPVK-MEEEIRQQ corresponding to amino acids 1-275 of Q9HCB6 (SEQ ID NO: 424), which also corresponds to amino acids 1-275 of M78530_PEA_1_P17 (SEQ ID NO: 428), and a second amino acid sequence being at least 70%, optionally at least 80%, preferably at least 85%, more preferably at least 90% and most preferably at least 95% homologous to a polypeptide having the sequence VRQKNHRMTK (SEQ ID NO: 1073) corresponding to amino acids 276-285 of M78530_PEA_1_P17 (SEQ ID NO: 428), wherein said first amino acid sequence and second amino acid sequence are contiguous and in a sequential order.

According to preferred embodiments of the present invention, there is provided an isolated polypeptide encoding for a tail of M78530_PEA_1_P17 (SEQ ID NO: 428), comprising a polypeptide being at least 70%, optionally at least about 80%, preferably at least about 85%, more preferably at least about 90% and most preferably at least about 95% homologous to the sequence VRQKNHRMTK (SEQ ID NO: 1073) in M78530_PEA_1_P17 (SEQ ID NO: 428).

According to preferred embodiments of the present invention, there is provided an isolated chimeric polypeptide encoding for M78530_PEA_1_P17 (SEQ ID NO: 428), comprising a first amino acid sequence being at least 70%, optionally at least 80%, preferably at least 85%, more preferably at least 90% and most preferably at least 95% homologous to a polypeptide having the sequence MRLSPAPLKLSRTPALLALALPLAAALAFSDETLDKVPKSEGYCSRILRAQGTRREGYT EFSLRVEGDPDFYKPGTSYRVTLS (SEQ ID NO: 1071) corresponding to amino acids 1-83 of M78530_PEA_1_P17 (SEQ ID NO: 428), a second amino acid sequence being at least 90% homologous to AAPPSYFRGFTLIALRENREGD-KEEDHAGTFQIIDEEETQFM-SNCPVAVTESTPRRRTRIQ VFWIAPPAGTGCVILKA-SIVQKRIIYFQDEGSLTKKLCEQDSTFDGVTDKPILD CCACGT AKYRLTFYGNWSEKTHPKDYPRRANHW-SAIIGGSHSKNYVLWEYGGYASEGVKQVAE LGSPVKMEEEIRQQ corresponding to amino acids 1-192 of O94862 (SEQ ID NO: 425), which also corresponds to amino acids 84-275 of M78530_PEA_1_P17 (SEQ ID NO: 428), and a third amino acid sequence being at least 70%, optionally at least 80%, preferably at least 85%, more preferably at least 90% and most preferably at least 95% homologous to a polypeptide having the sequence VRQKNHRMTK (SEQ ID NO: 1073) corresponding to amino acids 276-285 of M78530_PEA_1_P17 (SEQ ID NO: 428), wherein said first amino acid sequence, second amino acid sequence and third amino acid sequence are contiguous and in a sequential order.

According to preferred embodiments of the present invention, there is provided an isolated polypeptide encoding for a head of M78530_PEA_1_P17 (SEQ ID NO: 428), comprising a polypeptide being at least 70%, optionally at least about 80%, preferably at least about 85%, more preferably at least about 90% and most preferably at least about 95% homologous to the sequence MRLSPAPLKLSRTPALLALALP-LAAALAFSDETLDKVPKSEGYCSRIL-RAQGTRREGYT EFSLRVEGDPDFYKPGTSYRVTLS (SEQ ID NO: 1071) of M78530_PEA_1_P17 (SEQ ID NO: 428).

According to preferred embodiments of the present invention, there is provided an isolated polypeptide encoding for a tail of M78530_PEA_1_P17 (SEQ ID NO: 428), comprising a polypeptide being at least 70%, optionally at least about 80%, preferably at least about 85%, more preferably at least about 90% and most preferably at least about 95% homologous to the sequence VRQKNHRMTK (SEQ ID NO: 1073) in M78530_PEA_1_P17 (SEQ ID NO: 428).

According to preferred embodiments of the present invention, there is provided an isolated chimeric polypeptide encoding for T48119_P2 (SEQ ID NO: 450), comprising a first amino acid sequence being at least 90% homologous to MTRQMASSGASGGKIDNSVLVLIVGL-STVGAGAYAYKTMKEDEKRYNERISGLGLTPE QKQKKAALSASEGEEVPQDKAPSHVPFL-LIGGGTAAFAAARSIRARDPGARVLIVSEDP ELPYM-RPPLSKELWFSDDPNVTKTLRFKQWNGK-ERSIYFQPPSFYVSAQDLPHIENGGV AVLTGKKVVQLDVRDNMVKLNDGSQI-TYEKCLIATGGTPRSLSAIDRAGAEVKSRTTL FRKIGDFRSLEKISREVKSITIIGGG-FLGSELACALGRKARALGTEVIQLFPEKGNMGKILP EYLSNWTMEKVRREGVKVMPNAIVQS-VGVSSGKLLIKLKDGRKVETDHIVAAVGLEP NVE-LAKTGGLEIDSDFGGFRVNAELQARSNI-WVAGDAACFYDIKLGRRRVEHHDHAV VSGRLAGENMTGAAKPYWHQSMFWSDLG-PDVGYEAIGLVDSSLPTVGVFAKATAQD NPKSATE-QSGTGIRSESETESEASEITIPPST-PAVPQAPVQGEDYGKGVIFYLRDKVVVGI VLWNIFNRMPIARKIIKDGEQHEDLNEVAKLFNIHED corresponding to amino acids 50-613 of PCD8_HUMAN, which also corresponds to amino acids 1-564 of T48119_P2 (SEQ ID NO: 450).

According to preferred embodiments of the present invention, there is provided an isolated chimeric polypeptide encoding for T48119_P2 (SEQ ID NO: 450), comprising a first amino acid sequence being at least 90% homologous to MTRQMASSGASGGKIDNSVLVLIVGL-STVGAGAYAYKTMKEDEKRYNERISGLGLTPE QKQKKAALSASEGEEVPQDKAPSHVPFL-LIGGGTAAFAAARSIRARDPGARVLIVSEDP ELPYM-RPPLSKELWFSDDPNVTKTLRFKQWNGK-ERSIYFQPPSFYVSAQDLPHIENGGV AVLTGKKVVQLDVRDNMVKLNDGSQI-TYEKCLIATGGTPRSLSAIDRAGAEVKSRTTL FRKIGDFRSLEKISREVKSITIIGGG-FLGSELACALGRKARALGTEVIQLFPEKGNMGKILP EYLSNWTMEKVRREGVKVMPNAIVQS-VGVSSGKLLIKLKDGRKVETDHIVAAVGLEP NVE-LAKTGGLEIDSDFGGFRVNAELQARSNI-WVAGDAACFYDIKLGRRRVEHHDHAV VSGRLAGENMTGAAKPYWHQSMFWSDLG-PDVGYEAIGLVDSSLPTVGVFAKATAQD NPKSATE-QSGTGIRSESETESEASEITIPPST-PAVPQAPVQGEDYGKGVIFYLRDKVVVGI VLWNIFNRMPIARKIIKDGEQHEDLNEVAKLFNIHED corresponding to amino acids 50-613 of PCD8_HUMAN, which also corresponds to amino acids 1-564 of T48119_P2 (SEQ ID NO: 450).

According to preferred embodiments of the present invention, there is provided an isolated chimeric polypeptide encoding for T39971_P6 (SEQ ID NO: 603), comprising a first amino acid sequence being at least 90% homologous to MAPLRPLLILALLAWVALADQESCK-GRCTEGFNVDKKCQCDELCSYYQSCCTDYTAEC KPQVTRGDVFTMPEDEYTVYDDGEEKN-NATVHEQVGGPSLTSDLQAQSKGNPEQTPV LKPEEEAPAPEVGASKPEGIDSRPETLH-PGRPQPPAEEELCSGKPFDAFTDLKNGSLFAFR GQY-CYELDEKAVRPGYPKLIRDVWGIEGPI-DAAFTRINCQGKTYLFKGSQYWRFEDGV LDPDYPRNISDGFDGIPDNVDAALA-LPAHSYSGRERVYFFKG corresponding to amino acids 1-276 of VTNC_HUMAN, which also corresponds to amino acids 1-276 of T39971_P6 (SEQ ID NO: 603), and a second amino acid sequence being at least 70%, optionally at least 80%, preferably at least 85%, more preferably at least 90% and most preferably at least 95% homologous to a polypeptide having the sequence TQGVVGD corresponding to amino acids 277-283 of T39971_P6 (SEQ ID NO: 603), wherein said first and second amino acid sequences are contiguous and in a sequential order.

According to preferred embodiments of the present invention, there is provided an isolated polypeptide encoding for a tail of T39971_P6 (SEQ ID NO: 603), comprising a polypeptide being at least 70%, optionally at least about 80%, preferably at least about 85%, more preferably at least about 90% and most preferably at least about 95% homologous to the sequence TQGVVGD in T39971_P6 (SEQ ID NO: 603).

According to preferred embodiments of the present invention, there is provided an isolated chimeric polypeptide encoding for T39971_P9 (SEQ ID NO: 604), comprising a first amino acid sequence being at least 90% homologous to MAPLRPLLILALLAWVALADQESCK-GRCTEGFNVDKKCQCDELCSYYQSCCTDYTAEC KPQVTRGDVFTMPEDEYTVYDDGEEKN-NATVHEQVGGPSLTSDLQAQSKGNPEQTPV LKPEEEAPAPEVGASKPEGIDSRPETLH-PGRPQPPAEEELCSGKPFDAFTDLKNGSLFAFR GQY-CYELDEKAVRPGYPKLIRDVWGIEGPI-DAAFTRINCQGKTYLFKGSQYWRFEDGV LDPDYPRNISDGFDGIPDNVDAALA-LPAHSYSGRERVYFFKGKQYWEYQFQHQPSQEE CEGSSLSAVFEHFAMMQRDSWEDIFELLFWGRT corresponding to amino acids 1-325 of VTNC_HUMAN, which also corresponds to amino acids 1-325 of T39971_P9 (SEQ ID NO: 604), and a second amino acid sequence being at least 90% homologous to SGMAPRPSLAKKQRFRHRN-RKGYRSQRGHSRGRNQNSR-RPSRATWLSLFSSEESNLGA NNYDDYRMDWLVPAT-CEPIQSVFFFSGDKYYRVNLRTRRVDTVDPPYPRSIA QYWLGC PAPGHL corresponding to amino acids 357-478 of VTNC_HUMAN, which also corresponds to amino acids 326-447 of T39971_P9 (SEQ ID NO: 604), wherein said first and second amino acid sequences are contiguous and in a sequential order.

According to preferred embodiments of the present invention, there is provided an isolated chimeric polypeptide encoding for an edge portion of T39971_P9 (SEQ ID NO: 604), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TS, having a structure as follows: a sequence starting from any of amino acid numbers 325–x to 325; and ending at any of amino acid numbers 326+((n–2)–x), in which x varies from 0 to n–2.

According to preferred embodiments of the present invention, there is provided an isolated chimeric polypeptide encoding for T39971_P11 (SEQ ID NO: 605), comprising a first amino acid sequence being at least 90% homologous to MAPLRPLLILALLAWVALADQESCK-GRCTEGFNVDKKCQCDELCSYYQSCCTDYTAEC KPQVTRGDVFTMPEDEYTVYDDGEEKN-NATVHEQVGGPSLTSDLQAQSKGNPEQTPV LKPEEEAPAPEVGASKPEGIDSRPETLH-PGRPQPPAEEELCSGKPFDAFTDLKNGSLFAFR GQY-CYELDEKAVRPGYPKLIRDVWGIEGPI-DAAFTRINCQGKTYLFKGSQYWRFEDGV LDPDYPRNISDGFDGIPDNVDAALA-LPAHSYSGRERVYFFKGKQYWEYQFQHQPSQEE CEGSSLSAVFEHFAMMQRDSWEDIFELLFWGRTS corresponding to amino acids 1-326 of VTNC_HUMAN, which also corresponds to amino acids 1-326 of T39971_P11 (SEQ ID NO: 605), and a second amino acid sequence being at least 90% homologous to DKYYRVNLRTRRVDTVDPPYPR-SIAQYWLGCPAPGHL corresponding to amino acids 442-478 of VTNC_HUMAN, which also corresponds to amino acids 327-363 of T39971_P11 (SEQ ID NO: 605), wherein said first and second amino acid sequences are contiguous and in a sequential order.

According to preferred embodiments of the present invention, there is provided an isolated chimeric polypeptide encoding for an edge portion of T39971_P11 (SEQ ID NO: 605), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326–x to 326; and ending at any of amino acid numbers 327+((n–2)–x), in which x varies from 0 to n–2.

According to preferred embodiments of the present invention, there is provided an isolated chimeric polypeptide encoding for T39971_P11 (SEQ ID NO: 605), comprising a first amino acid sequence being at least 90% homologous to MAPLRPLLILALLAWVALADQESCK-GRCTEGFNVDKKCQCDELCSYYQSCCTDYTAEC KPQVTRGDVFTMPEDEYTVYDDGEEKN-NATVHEQVGGPSLTSDLQAQSKGNPEQTPV LKPEEEAPAPEVGASKPEGIDSRPETLH-PGRPQPPAEEELCSGKPFDAFTDLKNGSLFAFR GQY-CYELDEKAVRPGYPKLIRDVWGIEGPI-DAAFTRINCQGKTYLFKGSQYWRFEDGV LDPDYPRNISDGFDGIPDNVDAALA-LPAHSYSGRERVYFFKGKQYWEYQFQHQPSQEE CEGSSLSAVFEHFAMMQRDSWEDIFELLFWGRTS corresponding to amino acids 1-326 of Q9BSH7 (SEQ ID NO: 1000), which also corresponds to amino acids 1-326 of T39971_P11 (SEQ ID NO: 605), and a second amino acid sequence being at least 90% homologous to DKYYRVNLR-TRRVDTVDPPYPRSIAQYWLGCPAPGHL corresponding to amino acids 442-478 of Q9BSH7 (SEQ ID NO: 1000), which also corresponds to amino acids 327-363 of T39971_P11 (SEQ ID NO: 605), wherein said first and second amino acid sequences are contiguous and in a sequential order.

According to preferred embodiments of the present invention, there is provided an isolated chimeric polypeptide encoding for an edge portion of T39971_P11 (SEQ ID NO: 605), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326−x to 326; and ending at any of amino acid numbers 327+((n−2)−x), in which x varies from 0 to n−2.

According to preferred embodiments of the present invention, there is provided an isolated chimeric polypeptide encoding for T39971_P12 (SEQ ID NO: 606), comprising a first amino acid sequence being at least 90% homologous to MAPLRPLLILALLAWVALADQESCK-GRCTEGFNVDKKCQCDELCSYYQSCCTDYTAEC KPQVTRGDVFTMPEDEYTVYDDGEEKN-NATVHEQVGGPSLTSDLQAQSKGNPEQTPV LKPEEEAPAPEVGASKPEGIDSRPETLH-PGRPQPPAEEELCSGKPFDAFTDLKNGSLFAFR GQY-CYELDEKAVRPGYPKLIRDVWGIEGPI-DAAFTRINCQGKTYLFK corresponding to amino acids 1-223 of VTNC_HUMAN, which also corresponds to amino acids 1-223 of T39971_P12 (SEQ ID NO: 606), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO: 1076) corresponding to amino acids 224-238 of T39971_P12 (SEQ ID NO: 606), wherein said first and second amino acid sequences are contiguous and in a sequential order.

According to preferred embodiments of the present invention, there is provided an isolated polypeptide encoding for a tail of T39971_P12 (SEQ ID NO: 606), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO: 1076) in T39971_P12 (SEQ ID NO: 606).

According to preferred embodiments of the present invention, there is provided an isolated chimeric polypeptide encoding for T39971_P12 (SEQ ID NO: 606), comprising a first amino acid sequence being at least 90% homologous to MAPLRPLLILALLAWVALADQESCK-GRCTEGFNVDKKCQCDELCSYYQSCCTDYTAEC KPQVTRGDVFTMPEDEYTVYDDGEEKN-NATVHEQVGGPSLTSDLQAQSKGNPEQTPV LKPEEEAPAPEVGASKPEGIDSRPETLH-PGRPQPPAEEELCSGKPFDAFTDLKNGSLFAFR GQY-CYELDEKAVRPGYPKLIRDVWGIEGPI-DAAFTRINCQGKTYLFK corresponding to amino acids 1-223 of Q9BSH7 (SEQ ID NO: 1000), which also corresponds to amino acids 1-223 of T39971_P12 (SEQ ID NO: 606), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO: 1076) corresponding to amino acids 224-238 of T39971_P12 (SEQ ID NO: 606), wherein said first and second amino acid sequences are contiguous and in a sequential order.

According to preferred embodiments of the present invention, there is provided an isolated polypeptide encoding for a tail of T39971_P12 (SEQ ID NO: 606), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO: 1076) in T39971_P12 (SEQ ID NO: 606).

According to preferred embodiments of the present invention, there is provided an isolated chimeric polypeptide encoding for Z44808_PEA__1_P5 (SEQ ID NO: 634), comprising a first amino acid sequence being at least 90% homologous to MLLPQLCWLPLLAGLLPPVPAQKF-SALTFLRVDQDKDKDCSLDCAGSPQKPLCASDGR TFLSRCEFQRAKCKDPQLEIAYRGNCKD-VSRCVAERKYTQEQARKEFQQVFIPECNDD GTYSQVQCHSYTGYCWCVTPNGRPISG-TAVAHKTPRCPGSVNEKLPQREGTGKTDDAA APALETQPQGDEEDIASRYPTLWTEQVK-SRQNKTNKNSVSSCDQEHQSALEEAKQPKN DNVVI-PECAHGGLYKPVQCHPSTGYCWCVLVDT-GRPIPGTSTRYEQPKCDNTARAHPA KARDLYKGRQLQGCPGAKKHEFLTSV-LDALSTDMVHAASDPSSSSGRLSEPDPSHTLEE RVVHWYFKLLDKNSSGDIGKKEIK-PFKRFLRKKSKPKKCVKKFVEYCDVNNDKSISVQ ELMGCLGVAKEDGKADTKKRHTPRGHAESTSNRQ corresponding to amino acids 1-441 of SMO2_HUMAN, which also corresponds to amino acids 1-441 of Z44808_PEA__1_P5 (SEQ ID NO: 634), and a second amino acid sequence being at least 70%, optionally at least 80%, preferably at least 85%, more preferably at least 90% and most preferably at least 95% homologous to a polypeptide having the sequence DAMVVSSRPKATTHRKSRTLSRR (SEQ ID NO: 1077) corresponding to amino acids 442-464 of Z44808_PEA__1_P5 (SEQ ID NO: 634), wherein said first and second amino acid sequences are contiguous and in a sequential order.

According to preferred embodiments of the present invention, there is provided an isolated polypeptide encoding for a tail of Z44808_PEA__1_P5 (SEQ ID NO: 634), comprising a polypeptide being at least 70%, optionally at least about 80%, preferably at least about 85%, more preferably at least about 90% and most preferably at least about 95% homologous to the sequence DAMVVSSRPKATTHRKSRTLSRR (SEQ ID NO: 1077) in Z44808_PEA__1_P5 (SEQ ID NO: 634).

According to preferred embodiments of the present invention, there is provided an isolated chimeric polypeptide encoding for Z44808_PEA__1_P6 (SEQ ID NO: 635), comprising a first amino acid sequence being at least 90% homologous to MLLPQLCWLPLLAGLLPPVPAQKF-SALTFLRVDQDKDKDCSLDCAGSPQKPLCASDGR TFLSRCEFQRAKCKDPQLEIAYRGNCKD-VSRCVAERKYTQEQARKEFQQVFIPECNDD GTYSQVQCHSYTGYCWCVTPNGRPISG-TAVAHKTPRCPGSVNEKLPQREGTGKTDDAA APALETQPQGDEEDIASRYPTLWTEQVK-SRQNKTNKNSVSSCDQEHQSALEEAKQPKN DNVVI-PECAHGGLYKPVQCHPSTGYCWCVLVDT-GRPIPGTSTRYEQPKCDNTARAHPA KARDLYKGRQLQGCPGAKKHEFLTSV-LDALSTDMVHAASDPSSSSGRLSEPDPSHTLEE RVVHWYFKLLDKNSSGDIGKKEIK-PFKRFLRKKSKPKKCVKKFVEYCDVNNDKSISVQ ELMGCLGVAKEDGKADTKKRH corresponding to amino acids 1-428 of SMO2_HUMAN, which also corresponds to amino acids 1-428 of Z44808_PEA_1_P6 (SEQ ID NO: 635), and a second amino acid sequence being at least 70%, optionally at least 80%, preferably at least 85%, more preferably at least 90% and most preferably at least 95% homologous to a polypeptide having the sequence RSKRNL (SEQ ID NO: 1078) corresponding to amino acids 429-434 of Z44808_PEA_1_P6 (SEQ ID NO: 635), wherein said first and second amino acid sequences are contiguous and in a sequential order.

According to preferred embodiments of the present invention, there is provided an isolated polypeptide encoding for a tail of Z44808_PEA_1_P6 (SEQ ID NO: 635), comprising a polypeptide being at least 70%, optionally at least about 80%, preferably at least about 85%, more preferably at least about 90% and most preferably at least about 95% homologous to the sequence RSKRNL (SEQ ID NO: 1078) in Z44808_PEA_1_P6 (SEQ ID NO: 635).

According to preferred embodiments of the present invention, there is provided an isolated chimeric polypeptide encoding for Z44808_PEA_1_P7 (SEQ ID NO: 636), comprising a first amino acid sequence being at least 90% homologous to MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKN DNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQ corresponding to amino acids 1-441 of SMO2_HUMAN, which also corresponds to amino acids 1-441 of Z44808_PEA_1_P7 (SEQ ID NO: 636), and a second amino acid sequence being at least 70%, optionally at least 80%, preferably at least 85%, more preferably at least 90% and most preferably at least 95% homologous to a polypeptide having the sequence LLWLRGKVSFYCF (SEQ ID NO: 1079) corresponding to amino acids 442-454 of Z44808_PEA_1_P7 (SEQ ID NO: 636), wherein said first and second amino acid sequences are contiguous and in a sequential order.

According to preferred embodiments of the present invention, there is provided an isolated polypeptide encoding for a tail of Z44808_PEA_1_P7 (SEQ ID NO: 636), comprising a polypeptide being at least 70%, optionally at least about 80%, preferably at least about 85%, more preferably at least about 90% and most preferably at least about 95% homologous to the sequence LLWLRGKVSFYCF (SEQ ID NO: 1079) in Z44808_PEA_1_P7 (SEQ ID NO: 636).

According to preferred embodiments of the present invention, there is provided an isolated chimeric polypeptide encoding for Z44808_PEA_1_P11 (SEQ ID NO: 637), comprising a first amino acid sequence being at least 90% homologous to MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKT corresponding to amino acids 1-170 of SMO2_HUMAN, which also corresponds to amino acids 1-170 of Z44808_PEA_1_P11 (SEQ ID NO: 637), and a second amino acid sequence being at least 90% homologous to DIASRYPTLWTEQVKSRQNKTNKNSVSSCDQEHQSALEEAKQPKNDNVVIPECAHGGL YKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLD KNSSGDIGKKEIKPFKRFLRKKSKPKKCVKKFVEYCDVNNDKSISVQELMGCLGVAKEDGKADTKKRHTPRGHAESTSNRQPRKQG corresponding to amino acids 188-446 of SMO2_HUMAN, which also corresponds to amino acids 171-429 of Z44808_PEA_1_P11 (SEQ ID NO: 637), wherein said first and second amino acid sequences are contiguous and in a sequential order.

According to preferred embodiments of the present invention, there is provided an isolated chimeric polypeptide encoding for an edge portion of Z44808_PEA_1_P11 (SEQ ID NO: 637), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TD, having a structure as follows: a sequence starting from any of amino acid numbers 170−x to −170; and ending at any of amino acid numbers 171+((n−2)−x), in which x varies from 0 to n−2.

According to preferred embodiments of the present invention, there is provided an isolated chimeric polypeptide encoding for S67314_PEA_1_P4 (SEQ ID NO: 651), comprising a first amino acid sequence being at least 70%, optionally at least 80%, preferably at least 85%, more preferably at least 90% and most preferably at least 95% homologous to a polypeptide having the sequence MVDAFLGTWKLVDSKNFDDYMKSLGVGFATRQVASMTKPTTIIEKNGDILTLKTHSTF KNTEISFKLGVEFDETTADDRKVKSIVTLDGGKLVHLQKWDGQETTLVRELIDG KLIL corresponding to amino acids 1-116 of FABH_HUMAN, which also corresponds to amino acids 1-116 of S67314_PEA_1_P4 (SEQ ID NO: 651), and a second amino acid sequence being at least 70%, optionally at least 80%, preferably at least 85%, more preferably at least 90% and most preferably at least 95% homologous to a polypeptide having the sequence VRWATLELYLIGYYYCSFSQACSKKPSPPLRAVEAGTREWLWVRVVSGGNFLCSGFGL TQAGTQILPYRLHDCGQITFSKCNCKTGINNTNLVGLLGSL (SEQ ID NO: 1080) corresponding to amino acids 117-215 of S67314_PEA_1_P4 (SEQ ID NO: 651), wherein said first and second amino acid sequences are contiguous and in a sequential order.

According to preferred embodiments of the present invention, there is provided an isolated polypeptide encoding for a tail of S67314_PEA_1_P4 (SEQ ID NO: 651), comprising a polypeptide being at least 70%, optionally at least about 80%, preferably at least about 85%, more preferably at least about 90% and most preferably at least about 95% homologous to the sequence VRWATLELYLIGYYYCSFSQACSKKPSPPLRAVEAGTREWLWVRVVSGGNFLCSGFGL TQAGTQILPYRLHDCGQITFSKCNCKTGINNTNLVGLLGSL (SEQ ID NO: 1080) in S67314_PEA_1_P4 (SEQ ID NO: 651).

According to preferred embodiments of the present invention, there is provided an isolated chimeric polypeptide encoding for S67314_PEA_1_P4 (SEQ ID NO: 651), comprising a first amino acid sequence being at least 90% homologous to MVDAFLGTWKLVDSKNFDDYMK-SLGVGFATRQVASMTKPTTIIEKNGDILTLKTHSTF KNTEISFKLGVEFDETTADDRKVK-SIVTLDGGKLVHLQKWDGQETTLVRELIDGKLIL corresponding to amino acids 1-116 of AAP35373 (SEQ ID NO: 1007), which also corresponds to amino acids 1-116 of S67314_PEA_1_P4 (SEQ ID NO: 651), and a second amino acid sequence being at least 70%, optionally at least 80%, preferably at least 85%, more preferably at least 90% and most preferably at least 95% homologous to a polypeptide having the sequence VRWATLELYLIGYYYCSFSQAC-SKKPSPPLRAVEAGTREWLWVRVVSGGNFLCSGFGL TQAGTQILPYRLHDCGQITFSKCNCKT-GINNTNLVGLLGSL (SEQ ID NO: 1080) corresponding to amino acids 117-215 of S67314_PEA_1_P4 (SEQ ID NO: 651), wherein said first and second amino acid sequences are contiguous and in a sequential order.

According to preferred embodiments of the present invention, there is provided an isolated polypeptide encoding for a tail of S67314_PEA_1_P4 (SEQ ID NO: 651), comprising a polypeptide being at least 70%, optionally at least about 80%, preferably at least about 85%, more preferably at least about 90% and most preferably at least about 95% homologous to the sequence VRWATLELYLIGYYYCSFSQACSKKPSP-PLRAVEAGTREWLWVRVVSGGNFLCSGFGL TQAGT-QILPYRLHDCGQITFSKCNCKTGINNTNLVGLLGSL (SEQ ID NO: 1080) in S67314_PEA_1_P4 (SEQ ID NO: 651).

According to preferred embodiments of the present invention, there is provided an isolated chimeric polypeptide encoding for S67314_PEA_1_P5 (SEQ ID NO: 652), comprising a first amino acid sequence being at least 70%, optionally at least 80%, preferably at least 85%, more preferably at least 90% and most preferably at least 95% homologous to a polypeptide having the sequence MVDAFLGTWKLVD-SKNFDDYMKSLGVGFATRQVASMTKPT-TIIEKNGDILTLKTHSTF KNTEISFKLGVEFDETTAD-DRKVKSIVTLDGGKLVHLQKWDGQETTLVRELIDGKLIL corresponding to amino acids 1-116 of FABH_HUMAN, which also corresponds to amino acids 1-116 of S67314_PEA_1_P5 (SEQ ID NO: 652), and a second amino acid sequence being at least 70%, optionally at least 80%, preferably at least 85%, more preferably at least 90% and most preferably at least 95% homologous to a polypeptide having the sequence DVLTAWPSIYRRQVKVLREDEI-TILPWHLQWSREKATKLLRPTLPSYNNHGWEELRVG KSIV (SEQ ID NO: 1081) corresponding to amino acids 117-178 of S67314_PEA_1_P5 (SEQ ID NO: 652), wherein said first and second amino acid sequences are contiguous and in a sequential order.

According to preferred embodiments of the present invention, there is provided an isolated polypeptide encoding for a tail of S67314_PEA_1_P5 (SEQ ID NO: 652), comprising a polypeptide being at least 70%, optionally at least about 80%, preferably at least about 85%, more preferably at least about 90% and most preferably at least about 95% homologous to the sequence DVLTAWPSIYRRQVKVLREDEITILP-WHLQWSREKATKLLRPTLPSYNNHGWEELRVG KSIV (SEQ ID NO: 1081) in S67314_PEA_1_P5 (SEQ ID NO: 652).

According to preferred embodiments of the present invention, there is provided an isolated chimeric polypeptide encoding for S67314_PEA_1_P5 (SEQ ID NO: 652), comprising a first amino acid sequence being at least 90% homologous to MVDAFLGTWKLVDSKNFDDYMK-SLGVGFATRQVASMTKPTTIIEKNGDILTLKTHSTF KNTEISFKLGVEFDETTADDRKVK-SIVTLDGGKLVHLQKWDGQETTLVRELIDGKLIL corresponding to amino acids 1-116 of AAP35373 (SEQ ID NO: 1007), which also corresponds to amino acids 1-116 of S67314_PEA_1_P5 (SEQ ID NO: 652), and a second amino acid sequence being at least 70%, optionally at least 80%, preferably at least 85%, more preferably at least 90% and most preferably at least 95% homologous to a polypeptide having the sequence DVLTAWPSIYRRQVKVLREDEI-TILPWHLQWSREKATKLLRPTLPSYNNHGWEELRVG KSIV (SEQ ID NO: 1081) corresponding to amino acids 117-178 of S67314_PEA_1_P5 (SEQ ID NO: 652), wherein said first and second amino acid sequences are contiguous and in a sequential order.

According to preferred embodiments of the present invention, there is provided an isolated polypeptide encoding for a tail of S67314_PEA_1_P5 (SEQ ID NO: 652), comprising a polypeptide being at least 70%, optionally at least about 80%, preferably at least about 85%, more preferably at least about 90% and most preferably at least about 95% homologous to the sequence DVLTAWPSIYRRQVKVLREDEITILP-WHLQWSREKATKLLRPTLPSYNNHGWEELRVG KSIV (SEQ ID NO: 1081) in S67314_PEA_1_P5 (SEQ ID NO: 652).

According to preferred embodiments of the present invention, there is provided an isolated chimeric polypeptide encoding for S67314_PEA_1_P6 (SEQ ID NO: 653), comprising a first amino acid sequence being at least 70%, optionally at least 80%, preferably at least 85%, more preferably at least 90% and most preferably at least 95% homologous to a polypeptide having the sequence MVDAFLGTWKLVD-SKNFDDYMKSLGVGFATRQVASMTKPT-TIIEKNGDILTLKTHSTF KNTEISFKLGVEFDETTAD-DRKVKSIVTLDGGKLVHLQKWDGQETTLVRELIDG KLIL corresponding to amino acids 1-116 of FABH_HU-MAN, which also corresponds to amino acids 1-116 of S67314_PEA_1_P6 (SEQ ID NO: 653), and a second amino acid sequence being at least 70%, optionally at least 80%, preferably at least 85%, more preferably at least 90% and most preferably at least 95% homologous to a polypeptide having the sequence MEKLQLRNVK (SEQ ID NO: 1082) corresponding to amino acids 117-126 of S67314_PEA_1_P6 (SEQ ID NO: 653), wherein said first and second amino acid sequences are contiguous and in a sequential order.

According to preferred embodiments of the present invention, there is provided an isolated polypeptide encoding for a tail of S67314_PEA_1_P6 (SEQ ID NO: 653), comprising a polypeptide being at least 70%, optionally at least about 80%, preferably at least about 85%, more preferably at least about 90% and most preferably at least about 95% homologous to the sequence MEKLQLRNVK (SEQ ID NO: 1082) in S67314_PEA_1_P6 (SEQ ID NO: 653).

According to preferred embodiments of the present invention, there is provided an isolated chimeric polypeptide encoding for S67314_PEA_1_P6 (SEQ ID NO: 653), comprising a first amino acid sequence being at least 90% homologous to MVDAFLGTWKLVDSKNFDDYMK-SLGVGFATRQVASMTKPTTIIEKNGDILTLKTHSTF KNTEISFKLGVEFDETTADDRKVK-SIVTLDGGKLVHLQKWDGQETTLVRELIDGKLIL corresponding to amino acids 1-116 of AAP35373 (SEQ ID NO: 1007), which also corresponds to amino acids 1-116 of S67314_PEA_1_P6 (SEQ ID NO: 653), and a second amino acid sequence being at least 70%, optionally at least 80%, preferably at least 85%, more preferably at least 90% and most preferably at least 95% homologous to a polypeptide having the sequence MEKLQLRNVK (SEQ ID NO: 1082) corresponding to amino acids 117-126 of S67314_PEA_

1_P6 (SEQ ID NO: 653), wherein said first and second amino acid sequences are contiguous and in a sequential order.

According to preferred embodiments of the present invention, there is provided an isolated polypeptide encoding for a tail of S67314_PEA_1_P6 (SEQ ID NO: 653), comprising a polypeptide being at least 70%, optionally at least about 80%, preferably at least about 85%, more preferably at least about 90% and most preferably at least about 95% homologous to the sequence MEKLQLRNVK (SEQ ID NO: 1082) in S67314_PEA_1_P6 (SEQ ID NO: 653).

According to preferred embodiments of the present invention, there is provided an isolated chimeric polypeptide encoding for S67314_PEA_1_P7 (SEQ ID NO: 654), comprising a first amino acid sequence being at least 90% homologous to MVDAFLGTWKLVDSKNFDDYMKSL corresponding to amino acids 1-24 of FABH_HUMAN, which also corresponds to amino acids 1-24 of S67314_PEA_1_P7 (SEQ ID NO: 654), second amino acid sequence being at least 70%, optionally at least 80%, preferably at least 85%, more preferably at least 90% and most preferably at least 95% homologous to a polypeptide having the sequence AHILITFPLPS (SEQ ID NO: 1143) corresponding to amino acids 25-35 of S67314_PEA_1_P7 (SEQ ID NO: 654), and a third amino acid sequence being at least 90% homologous to GVGFATRQVASMTKPTTI-IEKNGDILTLKTHSTFKNTEIS-FKLGVEFDETTADDRKVKSI VTLDGGKLVHLQK-WDGQETTLVRELIDGKLILTLTHGTAVCTRTYEKEA corresponding to amino acids 25-133 of FABH_HUMAN, which also corresponds to amino acids 36-144 of S67314_PEA_1_P7 (SEQ ID NO: 654), wherein said first, second, third and fourth amino acid sequences are contiguous and in a sequential order.

According to preferred embodiments of the present invention, there is provided an isolated polypeptide encoding for an edge portion of S67314_PEA_1_P7 (SEQ ID NO: 654), comprising an amino acid sequence being at least 70%, optionally at least about 80%, preferably at least about 85%, more preferably at least about 90% and most preferably at least about 95% homologous to the sequence encoding for AHILITFPLPS (SEQ ID NO: 1143), corresponding to S67314_PEA_1_P7 (SEQ ID NO: 654).

According to preferred embodiments of the present invention, there is provided an isolated chimeric polypeptide encoding for S67314_PEA_1_P7 (SEQ ID NO: 654), comprising a first amino acid sequence being at least 90% homologous to MVDAFLGTWKLVDSKNFDDYMKSL corresponding to amino acids 1-24 of AAP35373 (SEQ ID NO: 1007), which also corresponds to amino acids 1-24 of S67314_PEA_1_P7 (SEQ ID NO: 654), second amino acid sequence being at least 70%, optionally at least 80%, preferably at least 85%, more preferably at least 90% and most preferably at least 95% homologous to a polypeptide having the sequence AHILITFPLPS (SEQ ID NO: 1143) corresponding to amino acids 25-35 of S67314_PEA_1_P7 (SEQ ID NO: 654), and a third amino acid sequence being at least 90% homologous to GVGFATRQVASMTKPTTI-IEKNGDILTLKTHSTFKNTEIS-FKLGVEFDETTADDRKVKSI VTLDGGKLVHLQK-WDGQETTLVRELIDGKLILTLTHGTAVCTRTYEKEA corresponding to amino acids 25-133 of AAP35373 (SEQ ID NO: 1007), which also corresponds to amino acids 36-144 of S67314_PEA_1_P7 (SEQ ID NO: 654), wherein said first, second and third amino acid sequences are contiguous and in a sequential order.

According to preferred embodiments of the present invention, there is provided an isolated polypeptide encoding for an edge portion of S67314_PEA_1_P7 (SEQ ID NO: 654), comprising an amino acid sequence being at least 70%, optionally at least about 80%, preferably at least about 85%, more preferably at least about 90% and most preferably at least about 95% homologous to the sequence encoding for AHILITFPLPS (SEQ ID NO: 1143), corresponding to S67314_PEA_1_P7 (SEQ ID NO: 654).

According to preferred embodiments of the present invention, there is provided an isolated chimeric polypeptide encoding for Z39337_PEA_2_PEA_1_P4 (SEQ ID NO: 671), comprising a first amino acid sequence being at least 70%, optionally at least 80%, preferably at least 85%, more preferably at least 90% and most preferably at least 95% homologous to a polypeptide having the sequence MWL-PLSGAA (SEQ ID NO: 1083) corresponding to amino acids 1-9 of Z39337_PEA_2_PEA_1_P4 (SEQ ID NO: 671), and a second amino acid sequence being at least 90% homologous to MKKLMVVLSLIAAAWAEEQNKLVHGG-PCDKTSHPYQAALYTSGHLLCGGVLIHPLWV LTAAHCKKPNLQVFLGKHNL-RQRESSQEQSSVVRAVIHPDYDAASH-DQDIMLLRLARP AKLSELIQPLPLERDC-SANTTSCHILGWGKTADGDFPDTIQCAYIHLVSREEC EHAYPGQ ITQNMLCAGDEKYGKDSCQGDSGG-PLVCGDHLRGLVSWGNIPCGSKEKPGVYTNVCR YTNWIQKTIQAK corresponding to amino acids 1-244 of KLK6_HUMAN, which also corresponds to amino acids 10-253 of Z39337_PEA_2_PEA_1_P4 (SEQ ID NO: 671), wherein said first amino acid sequence and second amino acid sequence are contiguous and in a sequential order.

According to preferred embodiments of the present invention, there is provided an isolated polypeptide encoding for a head of Z39337_PEA_2_PEA_1_P4 (SEQ ID NO: 671), comprising a polypeptide being at least 70%, optionally at least about 80%, preferably at least about 85%, more preferably at least about 90% and most preferably at least about 95% homologous to the sequence MWLPLSGAA (SEQ ID NO: 1083) of Z39337_PEA_2_PEA_1_P4 (SEQ ID NO: 671).

According to preferred embodiments of the present invention, there is provided an isolated chimeric polypeptide encoding for Z39337_PEA_2_PEA_1_P9 (SEQ ID NO: 672), comprising a first amino acid sequence being at least 90% homologous to MKKLMVVLSLIAAAWAE-EQNKLVHGGPCDKTSHPYQAALYTS-GHLLCGGVLIHPLWV LTAAHCKKPNLQVFLGKHNL-RQRESSQEQSSVVRAVIHPDYDAASHDQDIMLLRLA RP AKLSELIQPLPLERDCSANTTSCHILGWGKTADG corresponding to amino acids 1-149 of KLK6_HUMAN, which also corresponds to amino acids 1-149 of Z39337_PEA_2_PEA_1_P9 (SEQ ID NO: 672), and a second amino acid sequence being at least 70%, optionally at least 80%, preferably at least 85%, more preferably at least 90% and most preferably at least 95% homologous to a polypeptide having the sequence Q corresponding to amino acids 150-150 of Z39337_PEA_2_PEA_1_P9 (SEQ ID NO: 672), wherein said first amino acid sequence and second amino acid sequence are contiguous and in a sequential order.

According to preferred embodiments of the present invention, there is provided an isolated chimeric polypeptide encoding for HUMPHOSLIP_PEA_2_P10 (SEQ ID NO: 735), comprising a first amino acid sequence being at least 90% homologous to MALFGALFLALLAGAHAEFPGCK-IRVTSKALELVKQEGLRFLEQELETITIPDLRGKEGH FYYNISE corresponding to amino acids 1-67 of PLTP_HU-MAN, which also corresponds to amino acids 1-67 of HUM-PHOSLIP_PEA_2_P10 (SEQ ID NO: 735), and a second amino acid sequence being at least 90% homologous to KVY-DFLSTFITSGMRFLLNQQICPVLY-HAGTVLLNSLLDTVPVRSSVDELVGIDYSLMK DPVASTSNLDMDFRGAFFPLTERNWSLP-NRAVEPQLQEEERMVYVAFSEFFFDSAMES YFRAGALQLLLVGDKVPHDLDMLLRATY-FGSIVLLSPAVIDSPLKLELRVLAPPRCTIKP SGTTIS-VTASVTIALVPPDQPEVQLSSMTMDARL-SAKMALRGKALRTQLDLRRFRIYSN HSALESLALIPLQAPLKTMLQIGVMPML-NERTWRGVQIPLPEGINFVHEVVTNHAGFLTI GADL-HFAKGLREVIEKNRPADVRASTAPTPSTAAV corresponding to amino acids 163-493 of PLTP_HUMAN, which also corresponds to amino acids 68-398 of HUMPHOSLIP_PEA_2_P10 (SEQ ID NO: 735), wherein said first amino acid sequence and second amino acid sequence are contiguous and in a sequential order.

According to preferred embodiments of the present invention, there is provided an isolated chimeric polypeptide encoding for an edge portion of HUMPHOSLIP_PEA_2_P10 (SEQ ID NO: 735), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EK, having a structure as follows: a sequence starting from any of amino acid numbers 67−x to 67; and ending at any of amino acid numbers 68+((n−2)−x), in which x varies from 0 to n−2.

According to preferred embodiments of the present invention, there is provided an isolated chimeric polypeptide encoding for HUMPHOSLIP_PEA_2_P12 (SEQ ID NO: 736), comprising a first amino acid sequence being at least 90% homologous to MALFGALFLALLAGAHAEFPGCK-IRVTSKALELVKQEGLRFLEQELETITIPDLRGKEGH FYYNISEVKVTELQLTSSELD-FQPQQELMLQITNASLGLRFRRQLLYW-FFYDGGYINAS AEGVSIRTGLELSRDPAGRMKVSN-VSCQASVSRMHAAFGGTFKKVYDFLSTFITSGMRF LLNQQICPVLYHAGTVLLNSLL-DTVPVRSSVDELVGIDYSLMKDPVASTSNLDMDFRG AFFPLTERNWSLPNRAVEPQLQEEERM-VYVAFSEFFFDSAMESYFRAGALQLLLVGDK VPH-DLDMLLRATYFGSIVLLSPAVID-SPLKLELRVLAPPRCTIKPSGTTISVTASVTIALVP PDQPEVQLSSMTMDARLSAKMALRGKAL-RTQLDLRRFRIYSNHSALESLALIPLQAPLK TML-QIGVMPMLN corresponding to amino acids 1-427 of PLTP_HUMAN, which also corresponds to amino acids 1-427 of HUMPHOSLIP_PEA_2_P12 (SEQ ID NO: 736), and a second amino acid sequence being at least 70%, optionally at least 80%, preferably at least 85%, more preferably at least 90% and most preferably at least 95% homologous to a polypeptide having the sequence GKAGV (SEQ ID NO: 1084) corresponding to amino acids 428-432 of HUMPHOSLIP_PEA_2_P12 (SEQ ID NO: 736), wherein said first amino acid sequence and second amino acid sequence are contiguous and in a sequential order.

According to preferred embodiments of the present invention, there is provided an isolated polypeptide encoding for a tail of HUMPHOSLIP_PEA_2_P12 (SEQ ID NO: 736), comprising a polypeptide being at least 70%, optionally at least about 80%, preferably at least about 85%, more preferably at least about 90% and most preferably at least about 95% homologous to the sequence GKAGV (SEQ ID NO: 1084) in HUMPHOSLIP_PEA_2_P12 (SEQ ID NO: 736).

According to preferred embodiments of the present invention, there is provided an isolated chimeric polypeptide encoding for HUMPHOSLIP_PEA_2_P31 (SEQ ID NO: 738), comprising a first amino acid sequence being at least 90% homologous to MALFGALFLALLAGAHAEFPGCK-IRVTSKALELVKQEGLRFLEQELETITIPDLRGKEGH FYYNISE corresponding to amino acids 1-67 of PLTP_HUMAN, which also corresponds to amino acids 1-67 of HUMPHOSLIP_PEA_2_P31 (SEQ ID NO: 738), and a second amino acid sequence being at least 70%, optionally at least 80%, preferably at least 85%, more preferably at least 90% and most preferably at least 95% homologous to a polypeptide having the sequence PGLERGADKFPVVGGSSLFLA-LDLTLRPPVG (SEQ ID NO: 1085) corresponding to amino acids 68-98 of HUMPHOSLIP_PEA_2_P31 (SEQ ID NO: 738), wherein said first amino acid sequence and second amino acid sequence are contiguous and in a sequential order.

According to preferred embodiments of the present invention, there is provided an isolated polypeptide encoding for a tail of HUMPHOSLIP_PEA_2_P31 (SEQ ID NO: 738), comprising a polypeptide being at least 70%, optionally at least about 80%, preferably at least about 85%, more preferably at least about 90% and most preferably at least about 95% homologous to the sequence PGLERGADKFPV-VGGSSLFLALDLTLRPPVG (SEQ ID NO: 1085) in HUMPHOSLIP_PEA_2_P31 (SEQ ID NO: 738).

According to preferred embodiments of the present invention, there is provided an isolated chimeric polypeptide encoding for HUMPHOSLIP_PEA_2_P33 (SEQ ID NO: 739), comprising a first amino acid sequence being at least 90% homologous to MALFGALFLALLAGAHAEFPGCK-IRVTSKALELVKQEGLRFLEQELETITIPDLRGKEGH FYYNISEVKVTELQLTSSELD-FQPQQELMLQITNASLGLRFRRQLLYW-FFYDGGYINAS AEGVSIRTGLELSRDPAGRMKVSN-VSCQASVSRMHAAFGGTFKKVYDFLSTFITSGMRF LLNQQ corresponding to amino acids 1-183 of PLTP_HUMAN, which also corresponds to amino acids 1-183 of HUMPHOSLIP_PEA_2_P33 (SEQ ID NO: 739), and a second amino acid sequence being at least 70%, optionally at least 80%, preferably at least 85%, more preferably at least 90% and most preferably at least 95% homologous to a polypeptide having the sequence VWAATGRRVARVGMLSL (SEQ ID NO: 1086) corresponding to amino acids 184-200 of HUMPHOSLIP_PEA_2_P33 (SEQ ID NO: 739), wherein said first amino acid sequence and second amino acid sequence are contiguous and in a sequential order.

According to preferred embodiments of the present invention, there is provided an isolated polypeptide encoding for a tail of HUMPHOSLIP_PEA_2_P33 (SEQ ID NO: 739), comprising a polypeptide being at least 70%, optionally at least about 80%, preferably at least about 85%, more preferably at least about 90% and most preferably at least about 95% homologous to the sequence VWAATGRRVARVG-MLSL (SEQ ID NO: 1086) in HUMPHOSLIP_PEA_2_P33 (SEQ ID NO: 739).

According to preferred embodiments of the present invention, there is provided an isolated chimeric polypeptide encoding for HUMPHOSLIP_PEA_2_P34 (SEQ ID NO: 740), comprising a first amino acid sequence being at least 90% homologous to MALFGALFLALLAGAHAEFPGCK-IRVTSKALELVKQEGLRFLEQELETITIPDLRGKEGH FYYNISEVKVTELQLTSSELD-FQPQQELMLQITNASLGLRFRRQLLYW-FFYDGGYINAS AEGVSIRTGLELSRDPAGRMKVSN-VSCQASVSRMHAAFGGTFKKVYDFLSTFITSGMRF LLNQQICPVLYHAGTVLLNSLLDTVPV corresponding to amino acids 1-205 of PLTP_HUMAN, which also corresponds to amino acids 1-205 of HUMPHOSLIP_PEA_2_P34 (SEQ ID NO: 740), and a second amino acid sequence being at least 70%, optionally at least 80%, preferably at least 85%, more preferably at least 90% and most preferably at least 95% homologous to a polypeptide having the sequence LWTSLLALTIPS (SEQ ID NO: 1087) corresponding to amino acids 206-217 of HUMPHOSLIP_PEA_2_P34 (SEQ ID NO: 740), wherein said first amino acid sequence and second amino acid sequence are contiguous and in a sequential order.

According to preferred embodiments of the present invention, there is provided an isolated polypeptide encoding for a tail of HUMPHOSLIP_PEA_2_P34 (SEQ ID NO: 740), comprising a polypeptide being at least 70%, optionally at least about 80%, preferably at least about 85%, more preferably at least about 90% and most preferably at least about 95% homologous to the sequence LWTSLLALTIPS (SEQ ID NO: 1087) in HUMPHOSLIP_PEA_2_P34 (SEQ ID NO: 740).

According to preferred embodiments of the present invention, there is provided an isolated chimeric polypeptide encoding for HUMPHOSLIP_PEA_2_P35 (SEQ ID NO: 741), comprising a first amino acid sequence being at least 90% homologous to MALFGALFLALLAGAHAEFPGCK-IRVTSKALELVKQEGLRFLEQELETITIPDLRGKEGH FYYNISEVKVTELQLTSSELD-FQPQQELMLQITNASLGLRFRRQLLYWF corresponding to amino acids 1-109 of PLTP_HUMAN, which also corresponds to amino acids 1-109 of HUMPHOSLIP_PEA_2_P35 (SEQ ID NO: 741), a second amino acid sequence bridging amino acid sequence comprising of L, a third amino acid sequence being at least 90% homologous to KVYDFL-STFITSGMRFLLNQQ corresponding to amino acids 163-183 of PLTP_HUMAN, which also corresponds to amino acids 111-131 of HUMPHOSLIP_PEA_2_P35 (SEQ ID NO: 741), and a fourth amino acid sequence being at least 70%, optionally at least 80%, preferably at least 85%, more preferably at least 90% and most preferably at least 95% homologous to a polypeptide having the sequence VWAAT-GRRVARVGMLSL (SEQ ID NO: 1086) corresponding to amino acids 132-148 of HUMPHOSLIP_PEA_2_P35 (SEQ ID NO: 741), wherein said first amino acid sequence, second amino acid sequence, third amino acid sequence and fourth amino acid sequence are contiguous and in a sequential order.

According to preferred embodiments of the present invention, there is provided an isolated polypeptide encoding for an edge portion of HUMPHOSLIP_PEA_2_P35 (SEQ ID NO: 741), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise FLK having a structure as follows (numbering according to HUMPHOSLIP_PEA_2_P35 (SEQ ID NO: 741)): a sequence starting from any of amino acid numbers 109−x to 109; and ending at any of amino acid numbers 111+((n−2)−x), in which x varies from 0 to n−2.

According to preferred embodiments of the present invention, there is provided an isolated polypeptide encoding for a tail of HUMPHOSLIP_PEA_2_P35 (SEQ ID NO: 741), comprising a polypeptide being at least 70%, optionally at least about 80%, preferably at least about 85%, more preferably at least about 90% and most preferably at least about 95% homologous to the sequence VWAATGRRVARVG-MLSL (SEQ ID NO: 1086) in HUMPHOSLIP_PEA_2_P35 (SEQ ID NO: 741).

According to preferred embodiments of the present invention, there is provided an isolated chimeric polypeptide encoding for T59832_P7 (SEQ ID NO: 779), comprising a first amino acid sequence being at least 90% homologous to MTLSPLLLFLPPLLLLLDVPTAAVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVEACVLDELD-MELAFLTIVCMEEFEDMERSLPLCLQ-LYAPGLSPDTIM ECAMGDRGMQLMHANAQRT-DALQPPHEYVPWVTVNG corresponding to amino acids 12-223 of GILT_HUMAN, which also corresponds to amino acids 1-212 of T59832_P7 (SEQ ID NO: 779), and a second amino acid sequence being at least 70%, optionally at least 80%, preferably at least 85%, more preferably at least 90% and most preferably at least 95% homologous to a polypeptide having the sequence VRIFLALSLTLIVPWSQG-WTRQRDQR (SEQ ID NO: 1089) corresponding to amino acids 213-238 of T59832_P7 (SEQ ID NO: 779), wherein said first amino acid sequence and second amino acid sequence are contiguous and in a sequential order.

According to preferred embodiments of the present invention, there is provided an isolated polypeptide encoding for a tail of T59832_P7 (SEQ ID NO: 779), comprising a polypeptide being at least 70%, optionally at least about 80%, preferably at least about 85%, more preferably at least about 90% and most preferably at least about 95% homologous to the sequence VRIFLALSLTLIVPWSQGWTRQRDQR (SEQ ID NO: 1089) in T59832_P7 (SEQ ID NO: 779).

According to preferred embodiments of the present invention, there is provided an isolated chimeric polypeptide encoding for T59832_P9 (SEQ ID NO: 780), comprising a first amino acid sequence being at least 90% homologous to MTLSPLLLFLPPLLLLLDVPTAAVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVEACVLDELD-MELAFLTIVCMEEFEDMERSLPLCLQ-LYAPGLSPDTIM ECAMGDRGMQLMHANAQRT-DALQPPHE corresponding to amino acids 12-214 of GILT_HUMAN, which also corresponds to amino acids 1-203 of T59832_P9 (SEQ ID NO: 780), and a second amino acid sequence being at least 70%, optionally at least 80%, preferably at least 85%, more preferably at least 90% and most preferably at least 95% homologous to a polypeptide having the sequence NPWKIRPSSLPLSASCTRARSRM-SALPQPAPSGVFASSDGR (SEQ ID NO: 1090) corresponding to amino acids 204-244 of T59832_P9 (SEQ ID NO: 780), wherein said first amino acid sequence and second amino acid sequence are contiguous and in a sequential order.

According to preferred embodiments of the present invention, there is provided an isolated polypeptide encoding for a tail of T59832_P9 (SEQ ID NO: 780), comprising a polypeptide being at least 70%, optionally at least about 80%, preferably at least about 85%, more preferably at least about 90% and most preferably at least about 95% homologous to the sequence NPWKIRPSSLPLSASCTRARSRMSALPQ-PAPSGVFASSDGR (SEQ ID NO: 1090) in T59832_P9 (SEQ ID NO: 780).

According to preferred embodiments of the present invention, there is provided an isolated chimeric polypeptide encoding for T59832_P12 (SEQ ID NO: 781), comprising a first amino acid sequence being at least 90% homologous to MTLSPLLLFLPPLLLLLDVPTAAVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVE corresponding to amino acids 12-141 of GILT_HUMAN, which also corresponds to amino acids 1-130 of T59832_P12 (SEQ ID NO: 781), and a second amino acid sequence being at least 90% homologous to CLQ-LYAPGLSPDTIMECAMGDRGMQLMHA-NAQRTDALQPPHEYVPWVTVNGKPLED QTQLLTLVCQLYQGKKPDVCPSSTSSLRSVCFK corresponding to amino acids 173-261 of GILT_HUMAN, which also corresponds to amino acids 131-219 of T59832_P12 (SEQ ID NO: 781), wherein said first amino acid sequence and second amino acid sequence are contiguous and in a sequential order.

According to preferred embodiments of the present invention, there is provided an isolated chimeric polypeptide encoding for an edge portion of T59832_P12 (SEQ ID NO: 781), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EC, having a structure as follows: a sequence starting from any of amino acid numbers 130−x to 130; and ending at any of amino acid numbers 131+((n−2)−x), in which x varies from 0 to n−2.

According to preferred embodiments of the present invention, there is provided an isolated chimeric polypeptide encoding for T59832_P18 (SEQ ID NO: 782), comprising a first amino acid sequence being at least 90% homologous to MTLSPLLLFLPPLLLLLDVPTAAVQAS-PLQALDFFGNGPPVNYK corresponding to amino acids 12-55 of GILT_HUMAN, which also corresponds to amino acids 1-44 of T59832_P18 (SEQ ID NO: 782), and a second amino acid sequence being at least 90% homologous to CLQ-LYAPGLSPDTIMECAMGDRGMQLMHA-NAQRTDALQPPHEYVPWVTVNGKPLED QTQLLTLVCQLYQGKKPDVCPSSTSSLRSVCFK corresponding to amino acids 173-261 of GILT_HUMAN, which also corresponds to amino acids 45-133 of T59832_P18 (SEQ ID NO: 782), wherein said first amino acid sequence and second amino acid sequence are contiguous and in a sequential order.

According to preferred embodiments of the present invention, there is provided an isolated chimeric polypeptide encoding for an edge portion of T59832_P18 (SEQ ID NO: 782), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KC, having a structure as follows: a sequence starting from any of amino acid numbers 44−x to 44; and ending at any of amino acid numbers 45+((n−2)−x), in which x varies from 0 to n−2.

According to preferred embodiments of the present invention, there is provided an isolated chimeric polypeptide encoding for HSCP2_PEA_1_P4 (SEQ ID NO: 846), comprising a first amino acid sequence being at least 90% homologous to MKILILGIFLFLCST-PAWAKEKHYYIGIIETTWDYASDHGEKK-LISVDTEHSNIYLQNGPD RIGRLYKKALYLQYTDET-FRTTIEKPVWLGFLGPIIKAETGDKVYVHLKNLASRP YTFHS HGITYYKEHEGAIYPDNTTDFQRAD-DKVYPGEQYTYMLLATEEQSPGEGDGNCVTRIY HSHIDAPKDIASGLIGPLIICKKDSLD-KEKEKHIDREFVVMFSVVDENFSWYLEDNIKTY CSEPEKVDKDNEDFQESNRMYSVNGYT-FGSLPGLSMCAEDRVKWYLFGMGNEVDVH AAFFH-GQALTNKNYRIDTINLFPATLFDAYMVA-QNPGEWMLSCQNLNHLKAGLQAFF QVQECNKSSSKDNIRGKHVRHYY-IAAEEIIWNYAPSGIDIFTKENLTAPGSDSAVFFEQG TTRIGGSYKKLVYREYTDASFTNRKERG-PEEEHLGILGPVIWAEVGDTIRVTFHNKGAY PLSIEPIGVRFNKNNEGTYYSPNYN-PQSRSVPPSASHVAPTETFTYEWTVPKEVGPTNAD PVCLAKMYYSAVDPTKDIFTGLIGP-MKICKKGSLHANGRQKDVDKEFYLFPTVFDENES LLLEDNIRMFTTAPDQVDKEDED-FQESNKMHSMNGFMYGNQPGLTMCKGDSVVWYL FSAGNEADVHGIYFSGNTYLWRGERRD-TANLFPQTSLTLHMWPDTEGTFNVECLTTDH YTG-GMKQKYTVNQCRRQSEDSTFYLGERTYY-IAAVEVEWDYSPQREWEKELHHLQEQ NVSNAFLDKGEFYIGSKYKKVVYRQYTD-STFRVPVERKAEEEHLGILGPQLHADVGDK VKI-IFKNMATRPYSIHAHGVQT-ESSTVTPTLPGETLTYVWKIPERSGAGTEDSACIPWAY YSTVDQVKDLYSGLIGPLIVCR-RPYLKVFNPRRKLEFALLFLVFDENESW-YLDDNIKTYS DHPEKVNKDDEEFIESNKMHAIN-GRMFGNLQGLTMHVGDEVNWYLMGMGNEIDLHT VHFHGHSFQYKHRGVYSSDVFDIFPG-TYQTLEMFPRTPGIWLLHCHVTDHIHAGMETT YTV-LQNE corresponding to amino acids 1-1060 of CERU_HUMAN, which also corresponds to amino acids 1-1060 of HSCP2_PEA_1_P4 (SEQ ID NO: 846), and a second amino acid sequence being at least 70%, optionally at least 80%, preferably at least 85%, more preferably at least 90% and most preferably at least 95% homologous to a polypeptide having the sequence GGTSM (SEQ ID NO: 1091) corresponding to amino acids 1061-1065 of HSCP2_PEA_1_P4 (SEQ ID NO: 846), wherein said first amino acid sequence and second amino acid sequence are contiguous and in a sequential order.

According to preferred embodiments of the present invention, there is provided an isolated polypeptide encoding for a tail of HSCP2_PEA_1_P4 (SEQ ID NO: 846), comprising a polypeptide being at least 70%, optionally at least about 80%, preferably at least about 85%, more preferably at least about 90% and most preferably at least about 95% homologous to the sequence GGTSM (SEQ ID NO: 1091) in HSCP2_PEA_1_P4 (SEQ ID NO: 846).

According to preferred embodiments of the present invention, there is provided an isolated chimeric polypeptide encoding for HSCP2_PEA_1_P8 (SEQ ID NO: 847), comprising a first amino acid sequence being at least 90% homologous to MKILILGIFLFLCST-PAWAKEKHYYIGIIETTWDYASDHGEKK-LISVDTEHSNIYLQNGPD RIGRLYKKALYLQYTDET-FRTTIEKPVWLGFLGPIIKAETGDKVYVHLKNLASRP YTFHS HGITYYKEHEGAIYPDNTTDFQRAD-DKVYPGEQYTYMLLATEEQSPGEGDGNCVTRIY HSHIDAPKDIASGLIGPLIICKKDSLD-KEKEKHIDREFVVMFSVVDENFSWYLEDNIKTY CSEPEKVDKDNEDFQESNRMYSVNGYT-FGSLPGLSMCAEDRVKWYLFGMGNEVDVH AAFFH-GQALTNKNYRIDTINLFPATLFDAYMVA- QNPGEWMLSCQNLNHLKAGLQAFF QVQECNKSSSKDNIRGKHVRHYY-IAAEEIIWNYAPSGIDIFTKENLTAPGSDSAVFFEQG TTRIGGSYKKLVYREYTDASFTNRKERG-PEEEHLGILGPVIWAEVGDTIRVTFHNKGAY PLSIEPIGVRFNKNNEGTYYSPNYN-PQSRSVPPSASHVAPTETFTYEWTVPKEVGPTNAD PVCLAKMYYSAVDPTKDIFTGLIGP-MKICKKGSLHANGRQKDVDKEFYLFPTVFDENES LLLEDNIRMFTTAPDQVDKEDED-FQESNKMHSMNGFMYGNQPGLTMCKGDSVVWYL FSAGNEADVHGIYFSGNTYLWRGERRD-TANLFPQTSLTLHMWPDTEGTFNVECLTTDH YTG-GMKQKYTVNQCRRQSEDSTFYLGERTYY-IAAVEVEWDYSPQREWEKELHHLQEQ NVSNAFLDKGEFYIGSKYKKVVYRQYTD-STFRVPVERKAEEEHLGILGPQLHADVGDK VKI-IFKNMATRPYSIHAHGVQT-ESSTVTPTLPGETLTYVWKIPERSGAGTEDSACIPWAY YSTVDQVKDLYSGLIGPLIVCR-RPYLKVFNPRRKLEFALLFLVFDENESW-YLDDNIKTYS DHPEKVNKDDEEFIESNKMHAIN-GRMFGNLQGLTMHVGDEVNWYLMGMGNEIDLHT VHFHGHSFQYK corresponding to amino acids 1-1006 of CERU_HUMAN, which also corresponds to amino acids 1-1006 of HSCP2_PEA__1_P8 (SEQ ID NO: 847), and a second amino acid sequence being at least 70%, optionally at least 80%, preferably at least 85%, more preferably at least 90% and most preferably at least 95% homologous to a polypeptide having the sequence KCFQEHLEFGYSTAM (SEQ ID NO: 1092) corresponding to amino acids 1007-1021 of HSCP2_PEA__1_P8 (SEQ ID NO: 847), wherein said first amino acid sequence and second amino acid sequence are contiguous and in a sequential order.

According to preferred embodiments of the present invention, there is provided an isolated polypeptide encoding for a tail of HSCP2_PEA__1_P8 (SEQ ID NO: 847), comprising a polypeptide being at least 70%, optionally at least about 80%, preferably at least about 85%, more preferably at least about 90% and most preferably at least about 95% homologous to the sequence KCFQEHLEFGYSTAM (SEQ ID NO: 1092) in HSCP2_PEA__1_P8 (SEQ ID NO: 847).

According to preferred embodiments of the present invention, there is provided an isolated chimeric polypeptide encoding for HSCP2_PEA__1_P14 (SEQ ID NO: 848), comprising a first amino acid sequence being at least 90% homologous to MKILILGIFLFLCST-PAWAKEKHYYIGIIETTWDYASDHGEKK-LISVDTEHSNIYLQNGPD RIGRLYKKALYLQYTDET-FRTTIEKPVWLGFLGPIIKAETGDKVYVHLKNLASRP YTFHS HGITYYKEHEGAIYPDNTTDFQRAD-DKVYPGEQYTYMLLATEEQSPGEGDGNCVTRIY HSHIDAPKDIASGLIGPLIICKKDSLD-KEKEKHIDREFVVMFSVVDENFSWYLEDNIKTY CSEPEKVDKDNEDFQESNRMYSVNGYT-FGSLPGLSMCAEDRVKWYLFGMGNEVDVH AAFFH-GQALTNKNYRIDTINLFPATLFDAYMVA-QNPGEWMLSCQNLNHLKAGLQAFF QVQECNKSSSKDNIRGKHVRHYY-IAAEEIIWNYAPSGIDIFTKENLTAPGSDSAVFFEQG TTRIGGSYKKLVYREYTDASFTNRKERG-PEEEHLGILGPVIWAEVGDTIRVTFHNKGAY PLSIEPIGVRFNKNNEGTYYSPNYN-PQSRSVPPSASHVAPTETFTYEWTVPKEVGPTNAD PVCLAKMYYSAVDPTKDIFTGLIGP-MKICKKGSLHANGRQKDVDKEFYLFPTVFDENES LLLEDNIRMFTTAPDQVDKEDEDFQESNKMH corresponding to amino acids 1-621 of CERU_HUMAN, which also corresponds to amino acids 1-621 of HSCP2_PEA__1_P14 (SEQ ID NO: 848), a second amino acid sequence bridging amino acid sequence comprising of W, and a third amino acid sequence being at least 90% homologous to TFN-VECLTTDHYTGGMKQKYTVNQCRRQSED-STFYLGERTYYIAAVEVEWDYSPQRE WEKEL-HHLQEQNVSNAFLDKGEFYIGSKYKKVVYRQYTDS TFRVPVERKAEEEHLGIL GPQLHADVGDKVKIIFKN-MATRPYSIHAHGVQT-ESSTVTPTLPGETLTYVWKIPERSGA GTEDSACIP-WAYYSTVDQVKDLYSGLIGPLIVCRRPYLKVFNPRR KLEFALLFLVFDENE SWYLDDNIKTYSDHPE-KVNKDDEEFIESNKMHAINGRMFGN-LQGLTMHVGDEVNWYL MGMGNEIDLHTVHFHGH-SFQYKHRGVYSSDVFDIFPGTYQTLEMFPRTPGIWL LHCHV TDHIHAGMETTYTVLQNEDTKSG corresponding to amino acids 694-1065 of CERU_HUMAN, which also corresponds to amino acids 623-994 of HSCP2_PEA__1_P14 (SEQ ID NO: 848), wherein said first amino acid sequence, second amino acid sequence and third amino acid sequence are contiguous and in a sequential order.

According to preferred embodiments of the present invention, there is provided an isolated polypeptide encoding for an edge portion of HSCP2_PEA__1_P14 (SEQ ID NO: 848), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise HWT having a structure as follows (numbering according to HSCP2_PEA__1_P14 (SEQ ID NO: 848)): a sequence starting from any of amino acid numbers 621−x to 621; and ending at any of amino acid numbers 623+((n−2)−x), in which x varies from 0 to n−2.

According to preferred embodiments of the present invention, there is provided an isolated chimeric polypeptide encoding for HSCP2_PEA__1_P15 (SEQ ID NO: 849), comprising a first amino acid sequence being at least 90% homologous to MKILILGIFLFLCST-PAWAKEKHYYIGIIETTWDYASDHGEKK-LISVDTEHSNIYLQNGPD RIGRLYKKALYLQYTDET-FRTTIEKPVWLGFLGPIIKAETGDKVYVHLKNLASRP YTFHS HGITYYKEHEGAIYPDNTTDFQRAD-DKVYPGEQYTYMLLATEEQSPGEGDGNCVTRIY HSHIDAPKDIASGLIGPLIICKKDSLD-KEKEKHIDREFVVMFSVVDENFSWYLEDNIKTY CSEPEKVDKDNEDFQESNRMYSVNGYT-FGSLPGLSMCAEDRVKWYLFGMGNEVDVH AAFFH-GQALTNKNYRIDTINLFPATLFDAYMVA-QNPGEWMLSCQNLNHLKAGLQAFF QVQECNKSSSKDNIRGKHVRHYY-IAAEEIIWNYAPSGIDIFTKENLTAPGSDSAVFFEQG TTRIGGSYKKLVYREYTDASFTNRKERG-PEEEHLGILGPVIWAEVGDTIRVTFHNKGAY PLSIEPIGVRFNKNNEGTYYSPNYN-PQSRSVPPSASHVAPTETFTYEWTVPKEVGPTNAD PVCLAKMYYSAVDPTKDIFTGLIGP-MKICKKGSLHANGRQKDVDKEFYLFPTVFDENES LLLEDNIRMFTTAPDQVDKEDED-FQESNKMHSMNGFMYGNQPGLTMCKGDSVVWYL FSAGNEADVHGIYFSGNTYLWRGERRD-TANLFPQTSLTLHMWPDTEGTFNVECLTTDH YTG-GMKQKYTVNQCRRQSEDSTFYLGERTYY-IAAVEVEWDYSPQREWEKELHHLQEQ NVSNAFLDKGEFYIGSKYKKVVYRQYTD- STFRVPVERKAEEEHLGILGPQLHADVGDK VKI-IFKNMATRPYSIHAHGVQT-ESSTVTPTLPGETLTYVWKIPERSGAGTEDSACIPWAY YSTVDQVKDLYSGLIGPLIVCR-RPYLKVFNPRRKLEFALLFLVFDENESW-YLDDNIKTYS DHPEKVNKDDEEFIESNKMHAIN-GRMFGNLQGLTMHVGDEVNWYLMGMGNEIDLHT VHFHGHSFQYKHRGVYSSDVFDIFPG-TYQTLEMFPRTPGIWLLHCHVTDHIHAGMETT YTVLQNE corresponding to amino acids 1-1060 of CERU_HUMAN, which also corresponds to amino acids 1-1060 of HSCP2_PEA_1_P15 (SEQ ID NO: 849), and a second amino acid sequence being at least 70%, optionally at least 80%, preferably at least 85%, more preferably at least 90% and most preferably at least 95% homologous to a polypeptide having the sequence GEYPASSETHRRIWNVIYP-ITVSVIILFQISTKE (SEQ ID NO: 1093) corresponding to amino acids 1061-1094 of HSCP2_PEA_1_P15 (SEQ ID NO: 849), wherein said first amino acid sequence and second amino acid sequence are contiguous and in a sequential order.

According to preferred embodiments of the present invention, there is provided an isolated polypeptide encoding for a tail of HSCP2_PEA_1_P15 (SEQ ID NO: 849), comprising a polypeptide being at least 70%, optionally at least about 80%, preferably at least about 85%, more preferably at least about 90% and most preferably at least about 95% homologous to the sequence GEYPASSETHRRIWNVIYPITVSVI-ILFQISTKE (SEQ ID NO: 1093) in HSCP2_PEA_1_P15 (SEQ ID NO: 849).

According to preferred embodiments of the present invention, there is provided an isolated chimeric polypeptide encoding for HSCP2_PEA_1_P2 (SEQ ID NO: 850), comprising a first amino acid sequence being at least 90% homologous to MKILILGIFLFLCST-PAWAKEKHYYIGIIETTWDYASDHGEKK-LISVDTEHSNIYLQNGPD RIGRLYKKALYLQYTDET-FRTTIEKPVWLGFLGPIIKAETGDKVYVHLKNLASRP YTFHS HGITYYKEHEGAIYPDNTTDFQRAD-DKVYPGEQYTYMLLATEEQSPGEGDGNCVTRIY HSHIDAPKDIASGLIGPLIICKKDSLD-KEKEKHIDREFVVMFSVVDENFSWYLEDNIKTY CSEPEKVDKDNEDFQESNRMYSVNGYT-FGSLPGLSMCAEDRVKWYLFGMGNEVDVH AAFFH-GQALTNKNYRIDTINLFPATLFDAYMVA-QNPGEWMLSCQNLNHLKAGLQAFF QVQECNKSSSKDNIRGKHVRHYY-IAAEEIIWNYAPSGIDIFTKENLTAPGSDSAVFFEQG TTRIGGSYKKLVYREYTDASFTNRKERG-PEEEHLGILGPVIWAEVGDTIRVTFHNKGAY PLSIEPIGVRFNKNNEGTYYSPNYN-PQSRSVPPSASHVAPTETFTYEWTVPKEVGPTNAD PVCLAKMYYSAVDPTKDIFTGLIGP-MKICKKGSLHANGRQKDVDKEFYLFPTVFDENES LLLEDNIRMFTTAPDQVDKEDED-FQESNKMHSMNGFMYGNQPGLTMCKGDSVVWYL FSAGNEADVHGIYFSGNTYLWRGERRD-TANLFPQTSLTLHMWPDTEGTFNVECLTTDH YTG-GMKQKYTVNQCRRQSEDSTFYLGERTYY-IAAVEVEWDYSPQREWEKELHHLQEQ corresponding to amino acids 1-761 of CERU_HUMAN, which also corresponds to amino acids 1-761 of HSCP2_PEA_1_P2 (SEQ ID NO: 850), and a second amino acid sequence being at least 70%, optionally at least 80%, preferably at least 85%, more preferably at least 90% and most preferably at least 95% homologous to a polypeptide having the sequence K corresponding to amino acids 762-762 of HSCP2_PEA_1_P2 (SEQ ID NO: 850), wherein said first amino acid sequence and second amino acid sequence are contiguous and in a sequential order.

According to preferred embodiments of the present invention, there is provided an isolated chimeric polypeptide encoding for HSCP2_PEA_1_P16 (SEQ ID NO: 851), comprising a first amino acid sequence being at least 90% homologous to MKILILGIFLFLCST-PAWAKEKHYYIGIIETTWDYASDHGEK-KILISVDTEHSNIYLQNGPD RIGRLYKKALYLQYTDE-TFRTTIEKPVWLGFLGPIIKAETGDKVYVHLKNLASR PYTFHS HGITYYKEHEGAIYPDNTTDFQRAD-DKVYPGEQYTYMLLATEEQSPGEGDGNCVTRIY HSHIDAPKDIASGLIGPLIICKKDSLD-KEKEKHIDREFVVMFSVVDENFSWYLEDNIKTY CSEPEKVDKDNEDFQESNRMYSVNGYT-FGSLPGLSMCAEDRVKWYLFGMGNEVDVH AAFFH-GQALTNKNYRIDTINLFPATLFDAYMVA-QNPGEWMLSCQNLNHLKAGLQAFF QVQECNKSSSKDNIRGKHVRHYY-IAAEEIIWNYAPSGIDIFTKENLTAPGSDSAVFFEQG TTRIGGSYKKLVYREYTDASFTNRKERG-PEEEHLGILGPVIWAEVGDTIRVTFHNKGAY PLSIEPIGVRFNKNNEGTYYSPNYN-PQSRSVPPSASHVAPTETFTYEWTVPKEVGPTNAD PVCLAKMYYSAVDPTKDIFTGLIGP-MKICKKGSLHANGRQKDVDKEFYLFPTVFDENES LLLEDNIRMFTTAPDQVDKEDED-FQESNKMHSMNGFMYGNQPGLTMCKGDSVVWYL FSAGNEADVHGIYFSGNTYLWRGERRD-TANLFPQTSLTLHMWPDTEGTFNVECLTTDH YTG-GMKQKYTVNQCRRQSEDSTFYLGERTYY-IAAVEVEWDYSPQREWEKELHHLQEQ NVSNAFLDKGEFYIGSKYKKVVYRQYTD-STFRVPVERKAEEEHLGILGPQLHADVGDK VKI-IFKNMATRPYSIHAHGVQT-ESSTVTPTLPGETLTYVWKIPERSGAGTEDSACIPWAY YSTVDQVKDLYSGLIGPLIVCR-RPYLKVFNPRRKLEFALLFLVFDENESW-YLDDNIKTYS DHPEKVNKDDEEFIESNKMHAIN-GRMFGNLQGLTMHVGDEVNWYLMGMGNEIDLHT VHFHGHSFQYKH corresponding to amino acids 1-1007 of CERU_HUMAN, which also corresponds to amino acids 1-1007 of HSCP2_PEA_1_P16 (SEQ ID NO: 851), and a second amino acid sequence being at least 70%, optionally at least 80%, preferably at least 85%, more preferably at least 90% and most preferably at least 95% homologous to a polypeptide having the sequence LLRLTGEYGM (SEQ ID NO: 1094) corresponding to amino acids 1008-1017 of HSCP2_PEA_1_P16 (SEQ ID NO: 851), wherein said first amino acid sequence and second amino acid sequence are contiguous and in a sequential order.

According to preferred embodiments of the present invention, there is provided an isolated polypeptide encoding for a tail of HSCP2_PEA_1_P16 (SEQ ID NO: 851), comprising a polypeptide being at least 70%, optionally at least about 80%, preferably at least about 85%, more preferably at least about 90% and most preferably at least about 95% homologous to the sequence LLRLTGEYGM (SEQ ID NO: 1094) in HSCP2_PEA_1_P16 (SEQ ID NO: 851).

According to preferred embodiments of the present invention, there is provided an isolated chimeric polypeptide encoding for HSCP2_PEA_1_P6 (SEQ ID NO: 852), comprising a first amino acid sequence being at least 90% homologous to MKILILGIFLFLCST-PAWAKEKHYYIGIIETTWDYASDHGEKK-LISVDTEHSNIYLQNGPD RIGRLYKKALYLQYTDET- FRTTIEKPVWLGFLGPIIKAETGDKVYVHLKNLASR PYTFHS HGITYYKEHEGAIYPDNTTDFQRAD- DKVYPGEQYTYMLLATEEQSPGEGDGNCVTRIY HSHIDAPKDIASGLIGPLIICKKDSLD- KEKEKHIDREFVVMFSVVDENFSWYLEDNIKTY CSEPEKVDKDNEDFQESNRMYSVNGYT- FGSLPGLSMCAEDRVKWYLFGMGNEVDVH AAFFH- GQALTNKNYRIDTINLFPATLFDAYMVA- QNPGEWMLSCQNLNHLKAGLQAFF QVQECNKSSSKDNIRGKHVRHYY- IAAEEIIWNYAPSGIDIFTKENLTAPGSDSAVFFEQG TTRIGGSYKKLVYREYTDASFTNRKERG- PEEEHLGILGPVIWAEVGDTIRVTFHNKGAY PLSIEPIGVRFNKNNEGTYYSPNYN- PQSRSVPPSASHVAPTETFTYEWTVPKEVGPTNAD PVCLAKMYYSAVDPTKDIFTGLIGP- MKICKKGSLHANGRQKDVDKEFYLFPTVFDENES LLLEDNIRMFTTAPDQVDKEDED- FQESNKMHSMNGFMYGNQPGLTMCKGDSVVWYL FSAGNEADVHGIYFSGNTYLWRGERRD- TANLFPQTSLTLHMWPDTEGTFNVECLTTDH YTG- GMKQKYTVNQCRRQSEDSTFYLGERTYY- IAAVEVEWDYSPQREWEKELHHLQEQ NVSNAFLDKGEFYIGSKYKKVVYRQYTD- STFRVPVERKAEEEHLGILGPQLHADVGDK VKI- IFKNMATRPYSIHAHGVQT- ESSTVTPTLPGETLTYVWKIPERSGAGTEDSACIPWAY YSTVDQVKDLYSGLIGPLIVCR- RPYLKVFNPRRKLEFALLFLVFDENESW- YLDDNIKTYS DHPEKVNKDDEEFIESNKMHAIN- GRMFGNLQGLTMHVGDEVNWYLMGMGNEIDLHT VHFHGHSFQYK corresponding to amino acids 1-1006 of CERU_HUMAN, which also corresponds to amino acids 1-1006 of HSCP2_PEA_1_P6 (SEQ ID NO: 852), and a second amino acid sequence being at least 70%, optionally at least 80%, preferably at least 85%, more preferably at least 90% and most preferably at least 95% homologous to a polypeptide having the sequence GSL corresponding to amino acids 1007-1009 of HSCP2_PEA_1_P6 (SEQ ID NO: 852), wherein said first amino acid sequence and second amino acid sequence are contiguous and in a sequential order.

According to preferred embodiments of the present invention, there is provided an isolated chimeric polypeptide encoding for HSCP2_PEA_1_P22 (SEQ ID NO: 853), comprising a first amino acid sequence being at least 90% homologous to MKILILGIFLFLCST- PAWAKEKHYYIGIIETTWDYASDHGEKK- LISVDTEHSNIYLQNGPD RIGRLYKKALYLQYTDET- FRTTIEKPVWLGFLGPIIKAETGDKVYVHLKNLASRP YTFHS HGITYYKEHE corresponding to amino acids 1-131 of CERU_HUMAN, which also corresponds to amino acids 1-131 of HSCP2_PEA_1_P22 (SEQ ID NO: 853), a second amino acid sequence bridging amino acid sequence comprising of A, and a third amino acid sequence being at least 90% homologous to VNGYTFGSLPGLSMCAEDRVKWYLFG- MGNEVDVHAAFFHGQALTNKNYRIDTINLFP ATLF- DAYMVAQNPGEWMLSCQNLNHLKA- GLQAFFQVQECNKSSSKDNIRGKHVRHY YIAAEEIIWNYAPSGIDIFTKENL- TAPGSDSAVFFEQGTTRIGGSYKKLVYREYTDASFTN RKERGPEEEHLGILGPVIWAE- VGDTIRVTFHNKGAYPLSIEPIGVR- FNKNNEGTYYSPNY NPQSRSVPPSASHVAPTET- FTYEWTVPKEVGPTNADPVCLAKMYYSAVDPTKDI FTGLI GPMKICKKGSLHANGRQKDVDKEFYLF- PTVFDENESLLLEDNIRMFTTAPDQVDKEDE DFQESNKMHSMNGFMYGNQPGLTMCK- GDSVVWYLFSAGNEADVHGIYFSGNTYLWR GER- RDTANLFPQTSLTLHMWPDTEGTFNVE- CLTTDHYTGGMKQKYTVNQCRRQSEDS TFYLGERTYYIAAVEVEWDYS- PQREWEKELHHLQEQNVSNAFLDKGE- FYIGSKYKKVV YRQYTDSTFRVPVERKAEEE- HLGILGPQLHADVGDKVKIIFKNMATRPYSIHAHGV QTE SSTVTPTLPGETLTYVWKIPERSGAGT- EDSACIPWAYYSTVDQVKDLYSGLIGPLIVCRR PYLKVFNPRRKLEFALLFLVFDENESW- YLDDNIKTYSDHPEKVNKDDEEFIESNKMHAI NGRMFGNLQGLTMHVGDEVNWYLMGMG- NEIDLHTVHFHGHSFQYKHRGVYSSDVF DIFPGTYQ- TLEMFPRTPGIWLLHCHVTDHIHAGMET- TYTVLQNEDTKSG corresponding to amino acids 262-1065 of CERU_HUMAN, which also corresponds to amino acids 133-936 of HSCP2_PEA_1_P22 (SEQ ID NO: 853), wherein said first amino acid sequence, second amino acid sequence and third amino acid sequence are contiguous and in a sequential order.

According to preferred embodiments of the present invention, there is provided an isolated polypeptide encoding for an edge portion of HSCP2_PEA_1_P22 (SEQ ID NO: 853), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EAV having a structure as follows (numbering according to HSCP2_PEA_1_P22 (SEQ ID NO: 853)): a sequence starting from any of amino acid numbers 131-x to 131; and ending at any of amino acid numbers 133+((n−2)−x), in which x varies from 0 to n−2.

According to preferred embodiments of the present invention, there is provided an isolated chimeric polypeptide encoding for HSCP2_PEA_1_P24 (SEQ ID NO: 854), comprising a first amino acid sequence being at least 70%, optionally at least 80%, preferably at least 85%, more preferably at least 90% and most preferably at least 95% homologous to a polypeptide having the sequence MPLTMGKRNLFLLTP (SEQ ID NO: 1095) corresponding to amino acids 1-15 of HSCP2_PEA_1_P24 (SEQ ID NO: 854), and a second amino acid sequence being at least 90% homologous to VNGYTFGSLPGLSMCAEDRVKWYLFG- MGNEVDVHAAFFHGQALTNKNYRIDTINLFP ATLF- DAYMVAQNPGEWMLSCQNLNHLKA- GLQAFFQVQECNKSSSKDNIRGKHVRHY YIAAEEIIWNYAPSGIDIFTKENL- TAPGSDSAVFFEQGTTRIGGSYKKLVYREYTDASFTN RKERGPEEEHLGILGPVIWAE- VGDTIRVTFHNKGAYPLSIEPIGVR- FNKNNEGTYYSPNY NPQSRSVPPSASHVAPTET- FTYEWTVPKEVGPTNADPVCLAKMYYSAVDPTKDI FTGLI GPMKICKKGSLHANGRQKDVDKEFYLF- PTVFDENESLLLEDNIRMFTTAPDQVDKEDE DFQESNKMHSMNGFMYGNQPGLTMCK- GDSVVWYLFSAGNEADVHGIYFSGNTYLWR GER- RDTANLFPQTSLTLHMWPDTEGTFNVE- CLTTDHYTGGMKQKYTVNQCRRQSEDS TFYLGERTYYIAAVEVEWDYS- PQREWEKELHHLQEQNVSNAFLDKGE- FYIGSKYKKVV YRQYTDSTFRVPVERKAEEE- HLGILGPQLHADVGDKVKIIFKNMATRPYSIHAHGV QTE SSTVTPTLPGETLTYVWKIPERSGAGT- EDSACIPWAYYSTVDQVKDLYSGLIGPLIVCRR PYLKVFNPRRKLEFALLFLVFDENESW- YLDDNIKTYSDHPEKVNKDDEEFIESNKMHAI NGRMFGNLQGLTMHVGDEVNWYLMGMG-NEIDLHTVHFHGHSFQYKHRGVYSSDVF DIFPGTYQ-TLEMFPRTPGIWLLHCHVTDHIHAGMET-TYTVLQNEDTKSG corresponding to amino acids 262-1065 of CERU_HUMAN, which also corresponds to amino acids 16-819 of HSCP2_PEA_1_P24 (SEQ ID NO: 854), wherein said first amino acid sequence and second amino acid sequence are contiguous and in a sequential order.

According to preferred embodiments of the present invention, there is provided an isolated polypeptide encoding for a head of HSCP2_PEA_1_P24 (SEQ ID NO: 854), comprising a polypeptide being at least 70%, optionally at least about 80%, preferably at least about 85%, more preferably at least about 90% and most preferably at least about 95% homologous to the sequence MPLTMGKRNLFLLTP (SEQ ID NO: 1095) of HSCP2_PEA_1_P24 (SEQ ID NO: 854).

According to preferred embodiments of the present invention, there is provided an isolated chimeric polypeptide encoding for HSCP2_PEA_1_P25 (SEQ ID NO: 855), comprising a first amino acid sequence being at least 90% homologous to MKILILGIFLFLCST-PAWAKEKHYYIGIIETTWDYASDHGEKK-LISVDTEHSNIYLQNGPD RIGRLYKKALYLQYTDET-FRTTIEKPVWLGFLGPIIKAETGDKVYVHLKNLASRP YTFHS HGITYYKEHEGAIYPDNTTDFQRAD-DKVYPGEQYTYMLLATEEQSPGEGDGNCVTRIY HSHIDAPKDIASGLIGPLIICKKDSLD-KEKEKHIDREFVVMFSVVDENFSWYLEDNIKTY CSEPEKVDKDNEDFQESNRMYSVNGYT-FGSLPGLSMCAEDRVKWYLFGMGNEVDVH AAFFH-GQALTNKNYRIDTINLFPATLFDAYMVA-QNPGEWMLSCQNLNHLKAGLQAFF QVQECNKSSSKDNIRGKHVRHYY-IAAEEIIWNYAPSGIDIFTKENLTAPGSDSAVFFEQG TTRIGGSYKKLVYREYTDASFTNRKERG-PEEEHLGILGPVIWAEVGDTIRVTFHNKGAY PLSIEPIGVRFNKNNEGTYYSPNYN-PQSRSVPPSASHVAPTETFTYEWTVPKEVGPTNAD PVCLAKMYYSAVDPTKDIFTGLIGP-MKICKKGSLHANGRQKDVDKEFYLFPTVFDENES LLLEDNIRMFTTAPDQVDKEDEDFQESNKMH corresponding to amino acids 1-621 of CERU_HUMAN, which also corresponds to amino acids 1-621 of HSCP2_PEA_1_P25 (SEQ ID NO: 855), and a second amino acid sequence being at least 70%, optionally at least 80%, preferably at least 85%, more preferably at least 90% and most preferably at least 95% homologous to a polypeptide having the sequence CKYCIIHQSTKLF (SEQ ID NO: 1096) corresponding to amino acids 622-634 of HSCP2_PEA_1_P25 (SEQ ID NO: 855), wherein said first amino acid sequence and second amino acid sequence are contiguous and in a sequential order.

According to preferred embodiments of the present invention, there is provided an isolated polypeptide encoding for a tail of HSCP2_PEA_1_P25 (SEQ ID NO: 855), comprising a polypeptide being at least 70%, optionally at least about 80%, preferably at least about 85%, more preferably at least about 90% and most preferably at least about 95% homologous to the sequence CKYCIIHQSTKLF (SEQ ID NO: 1096) in HSCP2_PEA_1_P25 (SEQ ID NO: 855).

According to preferred embodiments of the present invention, there is provided an isolated chimeric polypeptide encoding for HSCP2_PEA_1_P33 (SEQ ID NO: 856), comprising a first amino acid sequence being at least 90% homologous to MKILILGIFLFLCST-PAWAKEKHYYIGIIETTWDYASDHGEKK-LISVDTEHSNIYLQNGPD RIGRLYKKALYLQYTDET-FRTTIEKPVWLGFLGPIIKAETGDKVYVHLKNLASR PYTFHS HGITYYKEHEGAIYPDNTTDFQRAD-DKVYPGEQYTYMLLATEEQSPGEGDGNCVTRIY HSHIDAPKDIASGLIGPLIICKK corresponding to amino acids 1-202 of CERU_HUMAN, which also corresponds to amino acids 1-202 of HSCP2_PEA_1_P33 (SEQ ID NO: 856), and a second amino acid sequence being at least 70%, optionally at least 80%, preferably at least 85%, more preferably at least 90% and most preferably at least 95% homologous to a polypeptide having the sequence GTSSPYCT-CYMTKRQGQGSLSFKKKSSLLC (SEQ ID NO: 1097) corresponding to amino acids 203-232 of HSCP2_PEA_1_P33 (SEQ ID NO: 856), wherein said first amino acid sequence and second amino acid sequence are contiguous and in a sequential order.

According to preferred embodiments of the present invention, there is provided an isolated polypeptide encoding for a tail of HSCP2_PEA_1_P33 (SEQ ID NO: 856), comprising a polypeptide being at least 70%, optionally at least about 80%, preferably at least about 85%, more preferably at least about 90% and most preferably at least about 95% homologous to the sequence GTSSPYCTCYMTKRQGQGSLS-FKKKSSLLC (SEQ ID NO: 1097) in HSCP2_PEA_1_P33 (SEQ ID NO: 856).

According to preferred embodiments of the present invention, there is provided an isolated chimeric polypeptide encoding for HUMTEN_PEA_1_P5 (SEQ ID NO: 934), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTRLDAPSQIEVKDVT DTTALITWFKPLAEIDGIELTYGIKD-VPGDRTTIDLTEDENQYSIGNLKPDTEYEVSLISRR GDMSSNPAKETFTTGLDAPRNLR-RVSQTDNSITLEWRNGKAAIDSYRIKYAPISGGDHA EVDVPKSQQATTKTTLTGLRPGTEY-GIGVSAVKEDKESNPATINAATELDTPKDLQVSE TAETSLTLLWKTPLAKFDRYRLNYSLPT-GQWVQLPRNTTSYVLRGLEPGQEYNVLL TAEKGRHKSKPARVKASTEQAPELEN-LTVTEVGWDGLRLNWTAADQAYEHFIIQVQE ANKVEAARNLTVPGSLRAVDIPGLKAAT- PYTVSIYGVIQGYRTPVLSAEASTGETPNLG EVV-VAEVGWDALKLNWTAPEGAYEY-FFIQVQEADTVEAAQNLTVPGGLRSTDLPGLK AATHYTITIRGVTQDFSTTPLSVEVL-TEEVPDMGNLTVTEVSWDALRLNWTTPDGTYD QFT-IQVQEADQVEEAHNLTVPGSLRS-MEIPGLRAGTPYTVTLHGEVRGHSTRPLAVEVV TEDLPQLGDLAVSEVGWDGLRLNWTAAD-NAYEHFVIQVQEVNKVEAAQNLTLPGSLR AVDIPGLEAATPYRVSIYGVIRGYRTPV-LSAEASTAKEPEIGNLNVSDITPESFNLSWMA TDG-IFETFTIEIIDSNRLLETVEYNISGAER-TAHISGLPPSTDFIVYLSGLAPSIRTKTISATA T corresponding to amino acids 1-1525 of TENA_HUMAN_V1 (SEQ ID NO: 1011), which also corresponds to amino acids 1-1525 of HUMTEN_PEA_1_P5 (SEQ ID NO: 934), a second amino acid sequence being at least 70%, optionally at least 80%, preferably at least 85%, more preferably at least 90% and most preferably at least 95% homologous to a polypeptide having the sequence TEPKPQLGT-LIFSNITPKSFNMSWTTQAGLFAKIVINVSDAHSLHES QQFTVSGDAKQAH ITGLVENTGYDVSVAGT-TLAGDPTRPLTAFVI (SEQ ID NO: 1144) corresponding to amino acids 1526-1617 of HUMTEN_PEA_1_P5 (SEQ ID NO: 934), and a third amino acid sequence being at least 90% homologous to TEALPLLENLTISDINPYGFTVSW-MASENAFDSFLVTVVDSGKLLDPQEFTLSGTQRKLE LRGLITGIGYEVMVSGFTQGHQTKPL-RAEIVTEAEPEVDNLLVSDATPDGFRLSWTADE GVFDNFVLKIRDTKKQSEPLEITLLAP-ERTRDLTGLREATEYEIELYGISKGRRSQTVSAI ATTAMGSPKEVIFSDITEN-SATVSWRAPTAQVESFRITYVPITG-GTPSMVTVDGTKTQTR LVKLIPGVEYLVSIIAMKG-FEESEPVSGSFTTALDGPSGLVTANITDSEALARWQP AIATV DSYVISYTGEKVPEITRTVSGNTVEY-ALTDLEPATEYTLRIFAEKGPQKSSTITAKFTTDL DSPRDLTATEVQSETALLTWRPPRASVT-GYLLVYESVDGTVKEVIVGPDTTSYSLADLS PSTHYTAKIQALNGPLRSNMIQTIFT-TIGLLYPFPKDCSQAMLNGDTTSGLYTIYLNGDK AQALEVFCDMTSDGGGWIVFLRRKN-GRENFYQNWKAYAAGFGDRREEFWLGLDNLN KITAQGQYELRVDLRDHGETAFAVYD-KFSVGDAKTRYKLKVEGYSGTAGDSMAYHN GRSF-STFDKDTDSAITNCALSYKGAFW-YRNCHRVNLMGRYGDNNHSQGVNWFHWKG HEHSIQFAEMKLRPSNFRNLEGRRKRA corresponding to amino acids 1526-2201 of TENA_HUMAN_V1 (SEQ ID NO: 1011), which also corresponds to amino acids 1618-2293 of HUMTEN_PEA_1_P5 (SEQ ID NO: 934), wherein said first amino acid sequence, second amino acid sequence and third amino acid sequence are contiguous and in a sequential order.

According to preferred embodiments of the present invention, there is provided an isolated polypeptide encoding for an edge portion of HUMTEN_PEA_1_P5 (SEQ ID NO: 934), comprising an amino acid sequence being at least 70%, optionally at least about 80%, preferably at least about 85%, more preferably at least about 90% and most preferably at least about 95% homologous to the sequence encoding for TEPKPQLGTLIFSNITPKSFNMSWTTQA-GLFAKIVINVSDAHSLHESQQFTVSGDAKQAH ITGL-VENTGYDVSVAGTTLAGDPTRPLTAFVI (SEQ ID NO: 1144), corresponding to HUMTEN_PEA_1_P5 (SEQ ID NO: 934).

According to preferred embodiments of the present invention, there is provided an isolated chimeric polypeptide encoding for HUMTEN_PEA_1_P6 (SEQ ID NO: 935), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTRLDAPSQIEVKDVT DTTALITWFKPLAEIDGIELTYGIKD-VPGDRTTIDLTEDENQYSIGNLKPDTEYEVSLISRR GDMSSNPAKETFTTGLDAPRNLR-RVSQTDNSITLEWRNGKAAIDSYRIKYAPISGGDHA EVDVPKSQQATTKTTLTGLRPGTEY-GIGVSAVKEDKESNPATINAATELDTPKDLQVSE TAETSLTLLWKTPLAKFDRYRLNYSLPT-GQWVGVQLPRNTTSYVLRGLEPGQEYNVLL TAEKGRHKSKPARVKASTEQAPELEN-LTVTEVGWDGLRLNWTAADQAYEHFIIQVQE ANKVEAARNLTVPGSLRAVDIPGLKAAT-PYTVSIYGVIQGYRTPVLSAEASTGETPNLG EVV-VAEVGWDALKLNWTAPEGAYEY-FFIQVQEADTVEAAQNLTVPGGLRSTDLPGLK AATHYTITIRGVTQDFSTTPLSVEVL-TEEVPDMGNLTVTEVSWDALRLNWTTPDGTYD QFT-IQVQEADQVEEAHNLTVPGSLRS-MEIPGLRAGTPYTVTLHGEVRGHSTRPLAVEVV TEDLPQLGDLAVSEVGWDGLRLNWTAAD-NAYEHFVIQVQEVNKVEAAQNLTLPGSLR AVDIPGLEAATPYRVSIYGVIRGYRTPV-LSAEASTAKEPEIGNLNVSDITPESFNLSWMA TDG-IFETFTIEIIDSNRLLETVEYNISGAER-TAHISGLPPSTDFIVYLSGLAPSIRTKTISATA TTE corresponding to amino acids 1-1527 of TENA_HUMAN_V1 (SEQ ID NO: 1011), which also corresponds to amino acids 1-1527 of HUMTEN_PEA_1_P6 (SEQ ID NO: 935), and a second amino acid sequence being at least 70%, optionally at least 80%, preferably at least 85%, more preferably at least 90% and most preferably at least 95% homologous to a polypeptide having the sequence PKPQLGTLIFS-NITPKSFNMSWTTQAGLFAKIVINVSDAHSLHESQQF TVSGDAKQAHIT GLVENTGYDVSVAGTTLAGDPTR-PLTAFVITGTQSEVLTCLTQREKEISHLKGKFNKNTI FTANVYSLIFN (SEQ ID NO: 1098) corresponding to amino acids 1528-1658 of HUMTEN_PEA_1_P6 (SEQ ID NO: 935), wherein said first amino acid sequence and second amino acid sequence are contiguous and in a sequential order.

According to preferred embodiments of the present invention, there is provided an isolated polypeptide encoding for a tail of HUMTEN_PEA_1_P6 (SEQ ID NO: 935), comprising a polypeptide being at least 70%, optionally at least about 80%, preferably at least about 85%, more preferably at least about 90% and most preferably at least about 95% homologous to the sequence PKPQLGTLIFSNITPKSFNMSWTTQAGLFAKIVINVSDAHSLHESQQFTVSGDAKQAHITGLVENTGYDVSVAGTTLAGDPTRPLTAFVITGTQSEVLTCLTQREKEISHLKGKFNKNTIFTANVYSLIFN (SEQ ID NO: 1098) in HUMTEN_PEA_1_P6 (SEQ ID NO: 935).

According to preferred embodiments of the present invention, there is provided an isolated chimeric polypeptide encoding for HUMTEN_PEA_1_P7 (SEQ ID NO: 936), comprising a first amino acid sequence being at least 90% homologous to MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDC SDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQ CICHEGFTGLDCGQHSCPSDCNNLGQCVSGRCICNEGYSGEDCSEVSPPKDLVVTE VTE ETVNLAWDNEMRVTEYLVVYTPTHEGGLEMQFRVPGDQTSTIIQELEPGVEYFIRVFAI LENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLG EVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYD QFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLR AVDIPGLEAATPYRVSIYGVIRGYRTPVLSAEASTAKEPEIGNLNVSDITPESFNLSWMA TDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVT corresponding to amino acids 1-1617 of TENA_HUMAN_V1 (SEQ ID NO: 1011), which also corresponds to amino acids 1-1617 of HUMTEN_PEA_1_P7 (SEQ ID NO: 936), and a second amino acid sequence being at least 70%, optionally at least 80%, preferably at least 85%, more preferably at least 90% and most preferably at least 95% homologous to a polypeptide having the sequence GISNQVSHLFLFLVPFCVICLPDRHDFNIFVHIPYLIHKCSLLFHLLPTLPLVICT (SEQ ID NO: 1099) corresponding to amino acids 1618-1673 of HUMTEN_PEA_1_P7 (SEQ ID NO: 936), wherein said first amino acid sequence and second amino acid sequence are contiguous and in a sequential order.

According to preferred embodiments of the present invention, there is provided an isolated polypeptide encoding for a tail of HUMTEN_PEA_1_P7 (SEQ ID NO: 936), comprising a polypeptide being at least 70%, optionally at least about 80%, preferably at least about 85%, more preferably at least about 90% and most preferably at least about 95% homologous to the sequence GISNQVSHLFLFLVPFCVICLPDRHDFNIFVHIPYLIHKCSLLFHLLPTLPLVICT in (SEQ ID NO: 1099) HUMTEN_PEA_1_P7 (SEQ ID NO: 936).

According to preferred embodiments of the present invention, there is provided an isolated chimeric polypeptide encoding for HUMTEN_PEA_1_P8 (SEQ ID NO: 937), comprising a first amino acid sequence being at least 90% homologous to MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDC SDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQ CICHEGFTGLDCGQHSCPSDCNNLGQCVSGRCICNEGYSGEDCSEVSPPKDLVVTE VTE ETVNLAWDNEMRVTEYLVVYTPTHEGGLEMQFRVPGDQTSTIIQELEPGVEYFIRVFAI LENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSE TAETSLTLLWKTPLAKFDRYRLNYSLPT-GQWVGVQLPRNTTSYVLRGLEPGQEYNVLL TAEKGRHKSKPARVKASTEQAPELEN-LTVTEVGWDGLRLNWTAADQAYEHFIIQVQE ANKVEAARNLTVPGSLRAVDIPGLKAAT-PYTVSIYGVIQGYRTPVLSAEASTGETPNLG EVV-VAEVGWDALKLNWTAPEGAYEY-FFIQVQEADTVEAAQNLTVPGGLRSTDLPGLK AATHYTITIRGVTQDFSTTPLSVEVL-TEEVPDMGNLTVTEVSWDALRLNWTTPDGTYD QFT-IQVQEADQVEEAHNLTVPGSLRS-MEIPGLRAGTPYTVTLHGEVRGHSTRPLAVEVV TEDLPQLGDLAVSEVGWDGLRLNWTAAD-NAYEHFVIQVQEVNKVEAAQNLTLPGSLR AVDIPGLEAATPYRVSIYGVIRGYRTPV-LSAEASTAKEPEIGNLNVSDITPESFNLSWMA TDG-IFETFTIEIIDSNRLLETVEYNISGAER-TAHISGLPPSTDFIVYLSGLAPSIRTKTISATA T corresponding to amino acids 1-1525 of TENA_HUMAN_V1 (SEQ ID NO: 1011), which also corresponds to amino acids 1-1525 of HUMTEN_PEA_1_P8 (SEQ ID NO: 937), and a second amino acid sequence being at least 90% homologous to TEAEPEVDNLLVSDATPDGFRLSWTA-DEGVFDNFVLKIRDTKKQSEPLEITLLAPERTRD LTGLREATEYEIELYGISKGRRSQTVSA-IATTAMGSPKEVIFSDITENSATVSWRAPTAQV ESFRI-TYVPITGGTPSMVTVDGTKTQTR-LVKLIPGVEYLVSIIAMKGFEESEPVSGSFTTA LDGPSGLVTANITDSEALARWQ-PAIATVDSYVISYTGEKVPEITRTVSGNTVEYALTDLE PATEYTLRIFAEKGPQKSSTITAK-FTTDLDSPRDLTATEVQSETALLTWRPPRASVTGYL LVYESVDGTVKEVIVGPDTTSYSLADL-SPSTHYTAKIQALNGPLRSNMIQTIFTTIGLLYP FPKDCSQAMLNGDTTSGLYTIYLNGD-KAQALEVFCDMTSDGGGWIVFLRRKNGRENF YQN-WKAYAAGFGDRREEFWLGLDNLNKI-TAQGQYELRVDLRDHGETAFAVYDKFSV GDAKTRYKLKVEGYSGTAGDSMAYH-NGRSFSTFDKDTDSAITNCALSYKGAFWYRNC HRVNLMGRYGDNNHSQGVNWFHWKGHEH-SIQFAEMKLRPSNFRNLEGRRKRA corresponding to amino acids 1617-2201 of TENA_HUMAN_V1 (SEQ ID NO: 1011), which also corresponds to amino acids 1526-2110 of HUMTEN_PEA_1_P8 (SEQ ID NO: 937), wherein said first amino acid sequence and second amino acid sequence are contiguous and in a sequential order.

According to preferred embodiments of the present invention, there is provided an isolated chimeric polypeptide encoding for an edge portion of HUMTEN_PEA_1_P8 (SEQ ID NO: 937), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TT, having a structure as follows: a sequence starting from any of amino acid numbers 1525−x to 1525; and ending at any of amino acid numbers 1526+((n−2)−x), in which x varies from 0 to n−2.

According to preferred embodiments of the present invention, there is provided an isolated chimeric polypeptide encoding for HUMTEN_PEA_1_P10 (SEQ ID NO: 938), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTRLDAPSQIEVKDVT DTTALITWFKPLAEIDGIELTYGIKD-VPGDRTTIDLTEDENQYSIGNLKPDTEYEVSLISRR GDMSSNPAKETFTTGLDAPRNLR-RVSQTDNSITLEWRNGKAAIDSYRIKYAPISGGDHA EVDVPKSQQATTKTTLTGLRPGTEY-GIGVSAVKEDKESNPATINAATELDTPKDLQVSE TAETSLTLLWKTPLAKFDRYRLNYSLPT-GQWVGVQLPRNTTSYVLRGLEPGQEYNVLL TAEKGRHKSKPARVKASTEQAPELEN-LTVTEVGWDGLRLNWTAADQAYEHFIIQVQE ANKVEAARNLTVPGSLRAVDIPGLKAAT-PYTVSIYGVIQGYRTPVLSAEASTGETPNLG EVV-VAEVGWDALKLNWTAPEGAYEY-FFIQVQEADTVEAAQNLTVPGGLRSTDLPGLK AATHYTITIRGVTQDFSTTPLSVEVL corresponding to amino acids 1-1252 of TENA_HUMAN_V1 (SEQ ID NO: 1011), which also corresponds to amino acids 1-1252 of HUMTEN_PEA_1_P10 (SEQ ID NO: 938), and a second amino acid sequence being at least 90% homologous to TEDLPQLGDLAVSEVGWDGLRLNWTAAD-NAYEHFVIQVQEVNKVEAAQNLTLPGSLR AVDIPGLEAATPYRVSIYGVIRGYRTPV-LSAEASTAKEPEIGNLNVSDITPESFNLSWMA TDG-IFETFTIEIIDSNRLLETVEYNISGAER-TAHISGLPPSTDFIVYLSGLAPSIRTKTISATA TTEALPLLENLTISDINPYGFTVSW-MASENAFDSFLVTVVDSGKLLDPQEFTLSGTQRKL ELRGLITGIGYEVMVSGFTQGHQTKPL-RAEIVTEAEPEVDNLLVSDATPDGFRLSWTAD EGVFDNFVLKIRDTKKQSEPLEITLLAP-ERTRDLTGLREATEYEIELYGISKGRRSQTVSA IAT-TAMGSPKEVIFSDITEN-SATVSWRAPTAQVESFRITYVPITGGTPSMVTVDGTK TQT RLVKLIPGVEYLVSIIAMKG-FEESEPVSGSFTTALDGPSGLVTANITD-SEALARWQPAIAT VDSYVISYTGEKVPEITRTVS-GNTVEYALTDLEPATEYTLRIFAEKGPQKSSTITAKFT TD LDSPRDLTATEVQSETALLTWRPPRAS-VTGYLLVYESVDGTVKEVIVGPDTTSYSLADL SPSTHYTAKIQALNGPLRSNMIQTIFT-TIGLLYPFPKDCSQAMLNGDTTSGLYTIYLNGD KAQALEVFCDMTSDGGGWIVFLRRKN- GRENFYQNWKAYAAGFGDRREEFWLGLDNL NKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWK GHEHSIQFAEMKLRPSNFRNLEGRRKRA corresponding to amino acids 1344-2201 of TENA_HUMAN_V1 (SEQ ID NO: 1011), which also corresponds to amino acids 1253-2110 of HUMTEN_PEA_1_P10 (SEQ ID NO: 938), wherein said first amino acid sequence and second amino acid sequence are contiguous and in a sequential order.

According to preferred embodiments of the present invention, there is provided an isolated chimeric polypeptide encoding for an edge portion of HUMTEN_PEA_1_P10 (SEQ ID NO: 938), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LT, having a structure as follows: a sequence starting from any of amino acid numbers 1252−x to 1252; and ending at any of amino acid numbers 1253+((n−2)−x), in which x varies from 0 to n−2.

According to preferred embodiments of the present invention, there is provided an isolated chimeric polypeptide encoding for HUMTEN_PEA_1_P13 (SEQ ID NO: 940), comprising a first amino acid sequence being at least 90% homologous to MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDC SDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQ CICHEGFTGLDCGQHSCPSDCNNLGQCVSGRCICNEGYSGEDCSEVSPPKDLVVTE VTE ETVNLAWDNEMRVTEYLVVYTPTHEGGLEMQFRVPGDQTSTIIQELEPGVEYFIRVFAI LENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAAT- PYTVSIYGVIQGYRTPVLSAEASTGETPNLG EVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYD QFTIQVQEADQVEEAHNLTVPGSLRSMEIPGLRAGTPYTVTLHGEVRGHSTRPLAVEVV corresponding to amino acids 1-1343 of TENA_HUMAN_V1 (SEQ ID NO: 1011), which also corresponds to amino acids 1-1343 of HUMTEN_PEA_1_P13 (SEQ ID NO: 940), and a second amino acid sequence being at least 90% homologous to TAMGSPKEVIFSDITENSATVSWRAPTAQVESFRITYVPITGGTPSMVTVDGTKTQTRLV KLIPGVEYLVSIIAMKGFEESEPVSGSFTTALDGPSGLVTANITDSEALARWQPA IATVDS YVISYTGEKVPEITRTVSGNTVEYALTDLEPATEYTLRIFAEKGPQKSSTITAKFTTDLDS PRDLTATEVQSETALLTWRPPRASVTGYLLVYESVDGTVKEVIVGPDTTSYSLADLSPS THYTAKIQALNGPLRSNMIQTIFTTIGLLYPFPKDCSQAMLNGDTTSGLYTIYLNGDKAQ ALEVFCDMTSDGGGWIVFLRRKNGRENFYQNWKAYAAGFGDRREEFWLGLDNLNKIT AQGQYELRVDLRDHGETAFAVYDKFSVGDAKTRYKLKVEGYSGTAGDSMAYHNGRS FSTFDKDTDSAITNCALSYKGAFWYRNCHRVNLMGRYGDNNHSQGVNWFHWKGHEH SIQFAEMKLRPSNFRNLEGRRKRA corresponding to amino acids 1708-2201 of TENA_HUMAN_V1 (SEQ ID NO: 1011), which also corresponds to amino acids 1344-1837 of HUMTEN_PEA_1_P13 (SEQ ID NO: 940), wherein said first amino acid sequence and second amino acid sequence are contiguous and in a sequential order.

According to preferred embodiments of the present invention, there is provided an isolated chimeric polypeptide encoding for an edge portion of HUMTEN_PEA_1_P13 (SEQ ID NO: 940), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise VT, having a structure as follows: a sequence starting from any of amino acid numbers 1343−x to 1343; and ending at any of amino acid numbers 1344+((n−2)−x), in which x varies from 0 to n−2.

According to preferred embodiments of the present invention, there is provided an isolated chimeric polypeptide encoding for HUMTEN_PEA_1_P14 (SEQ ID NO: 941), comprising a first amino acid sequence being at least 90% homologous to MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDC SDMSCPNDCHQHGRCVNGMCVCDDGYTGED- CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTRLDAPSQIEVKDVT DTTALITWFKPLAEIDGIELTYGIKD-VPGDRTTIDLTEDENQYSIGNLKPDTEYEVSLISRR GDMSSNPAKETFTTGLDAPRNLR-RVSQTDNSITLEWRNGKAAIDSYRIKYAPISGGDHA EVDVPKSQQATTKTTLTGLRPGTEY-GIGVSAVKEDKESNPATINAATELDTPKDLQVSE TAETSLTLLWKTPLAKFDRYRLNYSLPT-GQWVGVQLPRNTTSYVLRGLEPGQEYNVLL TAEKGRHKSKPARVKASTEQAPELEN-LTVTEVGWDGLRLNWTAADQAYEHFIIQVQE ANKVEAARNLTVPGSLRAVDIPGLKAAT-PYTVSIYGVIQGYRTPVLSAEASTGETPNLG EVV-VAEVGWDALKLNWTAPEGAYEY-FFIQVQEADTVEAAQNLTVPGGLRSTDLPGLK AATHYTITIRGVTQDFSTTPLSVEVL-TEEVPDMGNLTVTEVSWDALRLNWTTPDGTYD QFT-IQVQEADQVEEAHNLTVPGSLRS-MEIPGLRAGTPYTVTLHGEVRGHSTRPLAVEVV TEDLPQLGDLAVSEVGWDGLRLNWTAAD-NAYEHFVIQVQEVNKVEAAQNLTLPGSLR AVDIPGLEAATPYRVSIYGVIRGYRTPV-LSAEASTAKEPEIGNLNVSDITPESFNLSWMA TDG-IFETFTIEIIDSNRLLETVEYNISGAER-TAHISGLPPSTDFIVYLSGLAPSIRTKTISATA TTEALPLLENLTISDINPYGFTVSW-MASENAFDSFLVTVVDSGKLLDPQEFTLSGTQRKL ELRGLITGIGYEVMVSGFTQGHQTKPL-RAEIVTEAEPEVDNLLVSDATPDGFRLSWTAD EGVFDNFVLKIRDTKKQSEPLEITLLAP-ERTRDLTGLREATEYEIELYGISKGRRSQTVSA IAT-TAMGSPKEVIFSDITEN-SATVSWRAPTAQVESFRITYVPITGGTPSMVTVDGTK TQT RLVKLIPGVEYLVSIIAMKG-FEESEPVSGSFTTALDGPSGLVTANITD-SEALARWQPAIAT VDSYVISYTGEKVPEITRTVS-GNTVEYALTDLEPATEYTLRIFAEKGPQKSSTITAKFT TD LDSPRDLTATEVQSETALLTWRPPRAS-VTGYLLVYESVDGTVKEVIVGPDTTSYSLADL SPSTHYTAKIQALNGPLRSNMIQTIFT-TIGLLYPFPKDCSQAMLNGDTTSGLYTIYLNGD KAQALEVFCDMTSDGGGWW corresponding to amino acids 1-2025 of TENA_HUMAN_V1 (SEQ ID NO: 1011), which also corresponds to amino acids 1-2025 of HUMTEN-_PEA__1_P14 (SEQ ID NO: 941), and a second amino acid sequence being at least 70%, optionally at least 80%, preferably at least 85%, more preferably at least 90% and most preferably at least 95% homologous to a polypeptide having the sequence STTRDCRALRPRGRGRGQSRGGEE-GDLLLMHSDTPMCEALQDSACHTEALRNSLLNKR MGNTLATF (SEQ ID NO: 1100) corresponding to amino acids 2026-2091 of HUMTEN_PEA__1_P14 (SEQ ID NO: 941), wherein said first amino acid sequence and second amino acid sequence are contiguous and in a sequential order.

According to preferred embodiments of the present invention, there is provided an isolated polypeptide encoding for a tail of HUMTEN_PEA__1_P14 (SEQ ID NO: 941), comprising a polypeptide being at least 70%, optionally at least about 80%, preferably at least about 85%, more preferably at least about 90% and most preferably at least about 95% homologous to the sequence STTRDCRALRPRGRGRGQSRG-GEEGDLLLMHSDTPMCEALQDSACHT-EALRNSLLNKR MGNTLATF (SEQ ID NO: 1100) in HUMTEN_PEA__1_P14 (SEQ ID NO: 941).

According to preferred embodiments of the present invention, there is provided an isolated chimeric polypeptide encoding for HUMTEN_PEA__1_P15 (SEQ ID NO: 942), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQWFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTRLDAPSQIEVKDVT DTTALITWFKPLAEIDGIELTYGIKD-VPGDRTTIDLTEDENQYSIGNLKPDTEYEVSLISRR GDMSSNPAKETFTTGLDAPRNLR-RVSQTDNSITLEWRNGKAAIDSYRIKYAPISGGDHA EVDVPKSQQATTKTTLTGLRPGTEY-GIGVSAVKEDKESNPATINAATELDTPKDLQVSE TAETSLTLLWKTPLAKFDRYRLNYSLPT-GQWVGVQLPRNTTSYVLRGLEPGQEYNVLL TAEKGRHKSKPARVKAS corresponding to amino acids 1-1070 of TENA_HUMAN_V1 (SEQ ID NO: 1011), which also corresponds to amino acids 1-1070 of HUMTEN_PEA__1_P15 (SEQ ID NO: 942), and a second amino acid sequence being at least 90% homologous to TEAEPEVDNLLVSDAT-PDGFRLSWTADEGVFDNFVLKIRDT-KKQSEPLEITLLAPERTRD LTGLREATEYEIELY-GISKGRRSQTVSAIATTAMGSPKEVIFSDITENSATVS WRAPTAQV ESFRITYVPITGGTPSMVTVDGTKTQTR-LVKLIPGVEYLVSIIAMKGFEESEPVSGSFTTA LDGPS-GLVTANITDSEALARWQPAIATVDSYVI-SYTGEKVPEITRTVSGNTVEYALTDLE PATEYTLRIFAEKGPQKSSTITAK-FTTDLDSPRDLTATEVQSETALLTWRPPRASVTGYL LVYESVDGTVKEVIVGPDTTSYSLADL-SPSTHYTAKIQALNGPLRSNMIQTIFTTIGLLYP FPKDCSQAMLNGDTTSGLYTIYLNGD-KAQALEVFCDMTSDGGGWIVFLRRKNGRENF YQN-WKAYAAGFGDRREEFWLGLDNLNKI-TAQGQYELRVDLRDHGETAFAVYDKFSV GDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA corresponding to amino acids 1617-2201 of TENA_HUMAN_V1 (SEQ ID NO: 1011), which also corresponds to amino acids 1071-1655 of HUMTEN_PEA_1_P15 (SEQ ID NO: 942), wherein said first amino acid sequence and second amino acid sequence are contiguous and in a sequential order.

According to preferred embodiments of the present invention, there is provided an isolated chimeric polypeptide encoding for an edge portion of HUMTEN_PEA_1_P15 (SEQ ID NO: 942), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise ST, having a structure as follows: a sequence starting from any of amino acid numbers 1070−x to 1070; and ending at any of amino acid numbers 1071+((n−2)−x), in which x varies from 0 to n−2.

According to preferred embodiments of the present invention, there is provided an isolated chimeric polypeptide encoding for HUMTEN_PEA_1_P16 (SEQ ID NO: 943), comprising a first amino acid sequence being at least 90% homologous to MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDC SDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQ CICHEGFTGLDCGQHSCPSDCNNLGQCVSGRCICNEGYSGEDCSEVSPPKDLVVTE VTE ETVNLAWDNEMRVTEYLVVYTPTHEGGLEMQFRVPGDQTSTIIQELEPGVEYFIRVFAI LENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKAS corresponding to amino acids 1-1070 of TENA_HUMAN_V1 (SEQ ID NO: 1011), which also corresponds to amino acids 1-1070 of HUMTEN_PEA_1_P16 (SEQ ID NO: 943), and a second amino acid sequence being at least 90% homologous to TAMGSPKEVIFSDITENSATVSWRAPTAQVESFRITYVPITGGTPSMVTVDGTKTQTRLV KLIPGVEYLVSIIAMKGFEESEPVSGSFTTALDGPSGLVTANITDSEALARWQPAIATVDS YVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRS FSTFDKDTDSAITNCALSYKGAFWYRNCHRVNLMGRYGDNNHSQGVNWFHWKGHEH SIQFAEMKLRPSNFRNLEGRRKRA corresponding to amino acids 1708-2201 of TENA_HUMAN_V1 (SEQ ID NO: 1011), which also corresponds to amino acids 1071-1564 of HUMTEN_PEA_1_P16 (SEQ ID NO: 943), wherein said first amino acid sequence and second amino acid sequence are contiguous and in a sequential order.

According to preferred embodiments of the present invention, there is provided an isolated chimeric polypeptide encoding for an edge portion of HUMTEN_PEA_1_P16 (SEQ ID NO: 943), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise ST, having a structure as follows: a sequence starting from any of amino acid numbers 1070−x to 1070; and ending at any of amino acid numbers 1071+((n−2)−x), in which x varies from 0 to n−2.

According to preferred embodiments of the present invention, there is provided an isolated chimeric polypeptide encoding for HUMTEN_PEA_1_P17 (SEQ ID NO: 944), comprising a first amino acid sequence being at least 90% homologous to MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDC SDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQ CICHEGFTGLDCGQHSCPSDCNNLGQCVSGRCICNEGYSGEDCSEVSPPKDLVVTE VTE ETVNLAWDNEMRVTEYLVVYTPTHEGGLEMQFRVPGDQTSTIIQELEPGVEYFIRVFAI LENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKD VPGDRTTIDLTEDENQYSIGNLKPDTEYEVSLISRR GDMSSNPAKETFTTGLDAPRNLR-RVSQTDNSITLEWRNGKAAIDSYRIKYAPISGGDHA EVDVPKSQQATTKTTLTGLRPGTEY-GIGVSAVKEDKESNPATINAATELDTPKDLQVSE TAETSLTLLWKTPLAKFDRYRLNYSLPT-GQWVGVQLPRNTTSYVLRGLEPGQEYNVLL TAEKGRHKSKPARVKASTEQAPELEN-LTVTEVGWDGLRLNWTAADQAYEHFIIQVQE ANKVEAARNLTVPGSLRAVDIPGLKAAT-PYTVSIYGVIQGYRTPVLSAEASTGETPNLG EVV-VAEVGWDALKLNWTAPEGAYEY-FFIQVQEADTVEAAQNLTVPGGLRSTDLPGLK AATHYTITIRGVTQDFSTTPLSVEVL-TEEVPDMGNLTVTEVSWDALRLNWTTPDGTYD QFT-IQVQEADQVEEAHNLTVPGSLRS-MEIPGLRAGTPYTVTLHGEVRGHSTRPLAVEVV TEDLPQLGDLAVSEVGWDGLRLNWTAAD-NAYEHFVIQVQEVNKVEAAQNLTLPGSLR AVDIPGLEAATPYRVSIYGVIRGYRTPV-LSAEASTAKEPEIGNLNVSDITPESFNLSWMA TDG-IFETFTIEIIDSNRLLETVEYNISGAER-TAHISGLPPSTDFIVYLSGLAPSIRTKTISATA TTEALPLLENLTISDINPYGFTVSW-MASENAFDSFLVTVVDSGKLLDPQEFTLSGTQRKL ELRGLITGIGYEVMVSGFTQGHQTKPL-RAEIVTEAEPEVDNLLVSDATPDGFRLSWTAD EGVFDNFVLKIRDTKKQSEPLEITLLAP-ERTRDLTGLREATEYEIELYGISKGRRSQTVSA IAT-TAMGSPKEVIFSDITEN-SATVSWRAPTAQVESFRITYVPITGGTPSMVTVDGTK TQT RLVKLIPGVEYLVSIIAMKG-FEESEPVSGSFTTALDGPSGLVTANITD-SEALARWQPAIAT VDSYVISYTGEKVPEITRTVS-GNTVEYALTDLEPATEYTLRIFAEKGPQKSSTITAKFT TD LDSPRDLTATEVQSETALLTWRPPRAS-VTGYLLVYESVDGTVKEVIVGPDTTSYSLADL SPSTHYTAKIQALNGPLRSNMIQTIFT-TIGLLYPFPKDCSQAMLNGDTTSGLYTIYLNGD KAQALEVFCDMTSDGGGWIV corresponding to amino acids 1-2025 of TENA_HUMAN_V1 (SEQ ID NO: 1011), which also corresponds to amino acids 1-2025 of HUMTEN_PEA__1_P17 (SEQ ID NO: 944), and a second amino acid sequence being at least 70%, optionally at least 80%, preferably at least 85%, more preferably at least 90% and most preferably at least 95% homologous to a polypeptide having the sequence TPWPTTMADPSPPLTRTQIQPSPTVL-CPTKGLSGTGTVTVST (SEQ ID NO: 1101) corresponding to amino acids 2026-2067 of HUMTEN_PEA__1_P17 (SEQ ID NO: 944), wherein said first amino acid sequence and second amino acid sequence are contiguous and in a sequential order.

According to preferred embodiments of the present invention, there is provided an isolated polypeptide encoding for a tail of HUMTEN_PEA__1_P17 (SEQ ID NO: 944), comprising a polypeptide being at least 70%, optionally at least about 80%, preferably at least about 85%, more preferably at least about 90% and most preferably at least about 95% homologous to the sequence TPWPTTMADPSPPLTRTQIQPSPTV-LCPTKGLSGTGTVTVST (SEQ ID NO: 1101) in HUMTEN_PEA__1_P17 (SEQ ID NO: 944).

According to preferred embodiments of the present invention, there is provided an isolated chimeric polypeptide encoding for HUMTEN_PEA__1_P20 (SEQ ID NO: 945), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTRLDAPSQIEVKDVT DTTALITWFKPLAEIDGIELTYGIKD-VPGDRTTIDLTEDENQYSIGNLKPDTEYEVSLISRR GDMSSNPAKETFTTGLDAPRNLR-RVSQTDNSITLEWRNGKAAIDSYRIKYAPISGGDHA EVDVPKSQQATTKTTLTGLRPGTEY-GIGVSAVKEDKESNPATINAATELDTPKDLQVSE TAETSLTLLWKTPLAKFDRYRLNYSLPT-GQWVGVQLPRNTTSYVLRGLEPGQEYNVLL TAEKGRHKSKPARVKASTEQAPELEN-LTVTEVGWDGLRLNWTAADQAYEHFIIQVQE ANKVEAARNLTVPGSLRAVDIPGLKAAT-PYTVSIYGVIQGYRTPVLSAEASTGETPNLG EVV-VAEVGWDALKLNWTAPEGAYEY-FFIQVQEADTVEAAQNLTVPGGLRSTDLPGLK AATHYTITIRGVTQDFSTTPLSVEVL-TEEVPDMGNLTVTEVSWDALRLNWTTPDGTYD QFT-IQVQEADQVEEAHNLTVPGSLRS-MEIPGLRAGTPYTVTLHGEVRGHSTRPLAVEVV TEDLPQLGDLAVSEVGWDGLRLNWTAAD-NAYEHFVIQVQEVNKVEAAQNLTLPGSLR AVDIPGLEAATPYRVSIYGVIRGYRTPV-LSAEASTAKEPEIGNLNVSDITPESFNLSWMA TDG-IFETFTIEIIDSNRLLETVEYNISGAER-TAHISGLPPSTDFIVYLSGLAPSIRTKTISATA TTEALPLLENLTISDINPYGFTVSW-MASENAFDSFLVTVVDSGKLLDPQEFTLSGTQRKL ELRGLITGIGYEVMVSGFTQGHQTKPL-RAEIVTEAEPEVDNLLVSDATPDGFRLSWTAD EGVFDNFVLKIRDTKKQSEPLEITLLAP-ERTRDLTGLREATEYEIELYGISKGRRSQTVSA IAT-TAMGSPKEVIFSDITEN-SATVSWRAPTAQVESFRITYVPITGGTPSMVTVDGTK TQT RLVKLIPGVEYLVSIIAMKG-FEESEPVSGSFTTALDGPSGLVTANITD-SEALARWQPAIAT VDSYVISYTGEKVPEITRTVS-GNTVEYALTDLEPATEYTLRIFAEKGPQKSSTITAKFT TD LDSPRDLTATEVQSETALLTWRPPRAS-VTGYLLVYESVDGTVKEVIVGPDTTSYSLADL SPSTHYTAKIQALNGPLRSNMIQTIFT-TIGLLYPFPKDCSQAMLNGDTTSGLYTIYLNGD KAQALEVFCDMTSDGGGWIVFLRRKN- GRENFYQNWKAYAAGFGDRREEFWLG corresponding to amino acids 1-2057 of TENA_HUMAN_V1 (SEQ ID NO: 1011), which also corresponds to amino acids 1-2057 of HUMTEN_PEA_1_P20 (SEQ ID NO: 945), and a second amino acid sequence being at least 70%, optionally at least 80%, preferably at least 85%, more preferably at least 90% and most preferably at least 95% homologous to a polypeptide having the sequence NAALHVYI (SEQ ID NO: 1102) corresponding to amino acids 2058-2065 of HUMTEN_PEA_1_P20 (SEQ ID NO: 945), wherein said first amino acid sequence and second amino acid sequence are contiguous and in a sequential order.

According to preferred embodiments of the present invention, there is provided an isolated polypeptide encoding for a tail of HUMTEN_PEA_1_P20 (SEQ ID NO: 945), comprising a polypeptide being at least 70%, optionally at least about 80%, preferably at least about 85%, more preferably at least about 90% and most preferably at least about 95% homologous to the sequence NAALHVYI (SEQ ID NO: 1102) in HUMTEN_PEA_1_P20 (SEQ ID NO: 945).

According to preferred embodiments of the present invention, there is provided an isolated chimeric polypeptide encoding for HUMTEN_PEA_1_P26 (SEQ ID NO: 946), comprising a first amino acid sequence being at least 90% homologous to MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDC SDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQ CICHEGFTGLDCGQHSCPSDCNNLGQCVSGRCICNEGYSGEDCSEVSPPKDLVVTEVTE ETVNLAWDNEMRVTEYLVVYTPTHEGGLEMQFRVPGDQTSTIIQELEPGVEYFIRVFAI LENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLG EVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMA TDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDLTGLREATEYEIELYGISKGRRSQTVSA IATT corresponding to amino acids 1-1708 of TENA_HUMAN_V1 (SEQ ID NO: 1011), which also corresponds to amino acids 1-1708 of HUMTEN_PEA_1_P26 (SEQ ID NO: 946), and a second amino acid sequence being at least 70%, optionally at least 80%, preferably at least 85%, more preferably at least 90% and most preferably at least 95% homologous to a polypeptide having the sequence GTVNKQERTEKSHDSGVFFSQG (SEQ ID NO: 1103) corresponding to amino acids 1709-1730 of HUMTEN_PEA_1_P26 (SEQ ID NO: 946), wherein said first amino acid sequence and second amino acid sequence are contiguous and in a sequential order.

According to preferred embodiments of the present invention, there is provided an isolated polypeptide encoding for a tail of HUMTEN_PEA_1_P26 (SEQ ID NO: 946), comprising a polypeptide being at least 70%, optionally at least about 80%, preferably at least about 85%, more preferably at least about 90% and most preferably at least about 95% homologous to the sequence GTVNKQERTEKSHDSGVFFSQG (SEQ ID NO: 1103) in HUMTEN_PEA_1_P26 (SEQ ID NO: 946).

According to preferred embodiments of the present invention, there is provided an isolated chimeric polypeptide encoding for HUMTEN_PEA_1_P27 (SEQ ID NO: 947), comprising a first amino acid sequence being at least 90% homologous to MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDC SDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQ CICHEGFTGLDCGQHSCPSDCNNLGQCVSGRCICNEGYSGEDCSEVSPPKDLVVTEVTE ETVNLAWDNEMRVTEYLVVYTPTHEGGLEMQFRVPGDQTSTIIQELEPGVEYFIRVFAI LENKKSIPVSARVATYLPAPEGLKFKSIKETSVEVEWDPLDIAFETWEIIFRNMNKEDEGEITKSLRRPETSYRQTGLAPGQEYEISL- HIVKNNTRGPGLKRVTTTRLDAPSQIEVKDVT
DTTALITWFKPLAEIDGIELTYGIKD-
VPGDRTTIDLTEDENQYSIGNLKPDTEYEVSLISRR
GDMSSNPAKETFTTGLDAPRNLR-
RVSQTDNSITLEWRNGKAAIDSYRIKYAPISGGDHA
EVDVPKSQQATTKTTLTGLRPGTEY-
GIGVSAVKEDKESNPATINAATELDTPKDLQVSE
TAETSLTLLWKTPLAKFDRYRLNYSLPT-
GQWVGVQLPRNTTSYVLRGLEPGQEYNVLL
TAEKGRHKSKPARVKASTEQAPELEN-
LTVTEVGWDGLRLNWTAADQAYEHFIIQVQE
ANKVEAARNLTVPGSLRAVDIPGLKAAT-
PYTVSIYGVIQGYRTPVLSAEASTGETPNLG EVV-
VAEVGWDALKLNWTAPEGAYEY-
FFIQVQEADTVEAAQNLTVPGGLRSTDLPGLK
AATHYTITIRGVTQDFSTTPLSVEVL-
TEEVPDMGNLTVTEVSWDALRLNWTTPDGTYD QFT-
IQVQEADQVEEAHNLTVPGSLRS-MEIPGLRAGTPYTVTLHGEVRGHSTRPLAVEVV T corresponding to amino acids 1-1344 of TENA_HUMAN_V1 (SEQ ID NO: 1011), which also corresponds to amino acids 1-1344 of HUMTEN_PEA__1_P27 (SEQ ID NO: 947), and a second amino acid sequence being at least 70%, optionally at least 80%, preferably at least 85%, more preferably at least 90% and most preferably at least 95% homologous to a polypeptide having the sequence GI corresponding to amino acids 1345-1346 of HUMTEN_PEA__1_P27 (SEQ ID NO: 947), wherein said first amino acid sequence and second amino acid sequence are contiguous and in a sequential order.

According to preferred embodiments of the present invention, there is provided an isolated chimeric polypeptide encoding for HUMTEN_PEA__1_P28 (SEQ ID NO: 948), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTRLDAPSQIEVKDVT DTTALITWFKPLAEIDGIELTYGIKD-VPGDRTTIDLTEDENQYSIGNLKPDTEYEVSLISRR GDMSSNPAKETFTTGLDAPRNLR-RVSQTDNSITLEWRNGKAAIDSYRIKYAPISGGDHA EVDVPKSQQATTKTTLTGLRPGTEY-GIGVSAVKEDKESNPATINAATELDTPKDLQVSE TAETSLTLLWKTPLAKFDRYRLNYSLPT-GQWVGVQLPRNTTSYVLRGLEPGQEYNVLL TAEKGRHKSKPARVKASTEQAPELEN-LTVTEVGWDGLRLNWTAADQAYEHFIIQVQE ANKVEAARNLTVPGSLRAVDIPGLKAAT-PYTVSIYGVIQGYRTPVLSAEASTGETPNLG EVV-VAEVGWDALKLNWTAPEGAYEY-FFIQVQEADTVEAAQNLTVPGGLRSTDLPGLK AATHYTITIRGVTQDFSTTPLSVEVLT corresponding to amino acids 1-1253 of TENA_HUMAN_V1 (SEQ ID NO: 1011), which also corresponds to amino acids 1-1253 of HUMTEN_PEA__1_P28 (SEQ ID NO: 948), and a second amino acid sequence being at least 70%, optionally at least 80%, preferably at least 85%, more preferably at least 90% and most preferably at least 95% homologous to a polypeptide having the sequence GILDEFTNSLPPLCLCSG-GIKALSCFKLGSAPTTLGKYQ (SEQ ID NO: 1104) corresponding to amino acids 1254-1292 of HUMTEN_PEA__1_P28 (SEQ ID NO: 948), wherein said first amino acid sequence and second amino acid sequence are contiguous and in a sequential order.

According to preferred embodiments of the present invention, there is provided an isolated polypeptide encoding for a tail of HUMTEN_PEA__1_P28 (SEQ ID NO: 948), comprising a polypeptide being at least 70%, optionally at least about 80%, preferably at least about 85%, more preferably at least about 90% and most preferably at least about 95% homologous to the sequence GILDEFTNSLPPLCLCSG-GIKALSCFKLGSAPTTLGKYQ (SEQ ID NO: 1104) in HUMTEN_PEA__1_P28 (SEQ ID NO: 948).

According to preferred embodiments of the present invention, there is provided an isolated chimeric polypeptide encoding for HUMTEN_PEA__1_P29 (SEQ ID NO: 949), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTRLDAPSQIEVKDVT DTTALITWFKPLAEIDGIELTYGIKD-VPGDRTTIDLTEDENQYSIGNLKPDTEYEVSLISRR GDMSSNPAKETFTTGLDAPRNLR-RVSQTDNSITLEWRNGKAAIDSYRIKYAPISGGDHA EVDVPKSQQATTKTTLTGLRPGTEY-
GIGVSAVKEDKESNPATINAATELDTPKDLQVSE
TAETSLTLLWKTPLAKFDRYRLNYSLPT-
GQWVGVQLPRNTTSYVLRGLEPGQEYNVLL
TAEKGRHKSKPARVKAST corresponding to amino acids 1-1071 of TENA_HUMAN_V1 (SEQ ID NO: 1011), which also corresponds to amino acids 1-1071 of HUMTEN_PEA_1_P29 (SEQ ID NO: 949), and a second amino acid sequence being at least 70%, optionally at least 80%, preferably at least 85%, more preferably at least 90% and most preferably at least 95% homologous to a polypeptide having the sequence GESALSFLQTLG (SEQ ID NO: 1105) corresponding to amino acids 1072-1083 of HUMTEN_PEA_1_P29 (SEQ ID NO: 949), wherein said first amino acid sequence and second amino acid sequence are contiguous and in a sequential order.

According to preferred embodiments of the present invention, there is provided an isolated polypeptide encoding for a tail of HUMTEN_PEA_1_P29 (SEQ ID NO: 949), comprising a polypeptide being at least 70%, optionally at least about 80%, preferably at least about 85%, more preferably at least about 90% and most preferably at least about 95% homologous to the sequence GESALSFLQTLG (SEQ ID NO: 1105) in HUMTEN_PEA_1_P29 (SEQ ID NO: 949).

According to preferred embodiments of the present invention, there is provided an isolated chimeric polypeptide encoding for HUMTEN_PEA_1_P30 (SEQ ID NO: 950), comprising a first amino acid sequence being at least 90% homologous to MGAMTQLLAGVFLAFLALATEGGV-
LKKVIRHKRQSGVNATLPEENQPVVFNHVYNIK
LPVGSQCSVDLESASGEKDLAPPSEPS-
ESFQEHTVDGENQIVFTHRINIPRRACGCAAAP
DVKELLSRLEELENLVSSLREQCTA-
GAGCCLQPATGRLDTRPFCSGRGNFSTEGCGCVC
EPGWKGPNCSEPECPGNCHLRGR-
CIDGQCICDDGFTGEDCSQLACPSDCNDQGKCVNG
VCICFEGYAGADCSREICPVPCSEEH-
GTCVDGLCVCHDGFAGDDCNKPLCLNNCYNRG
RCVENECVCDEGFTGEDCSELICPND-
CFDRGRCINGTCYCEEGFTGEDCGKPTCPHACH
TQGRCEEGQCVCDEGFAGVDCSEKRC-
PADCHNRGRCVDGRCECDDGFTGADCGELKC
PNGCSGHGRCVNGQCVCDEGYTGEDC-
SQLRCPNDCHSRGRCVEGKCVCEQGFKGYDC SDM-
SCPNDCHQHGRCVNGMCVCDDGYTGED-
CRDRQCPRDCSNRGLCVDGQCVCEDG
FTGPDCAELSCPNDCHGR-
GRCVNGQCVCHEGFMGKDCKEQRCPSD-
CHGQGRCVDGQ CICHEGFTGLDCGQHSCPSD-
CNNLGQCVSGRCICNEGYSGEDCSEVSPPKDLVVTE
VTE ETVNLAWDNEMRVTEYLVVYTPTHEG-
GLEMQFRVPGDQTSTIIQELEPGVEYFIRVFAI LEN-
KKSIPVSARVATYLPAPEGLKFK-
SIKETSVEVEWDPLDIAFETWEIIFRNMNKEDEG
EITKSLRRPETSYRQTGLAPGQEYEISL-
HIVKNNTRGPGLKRVTTTRLDAPSQIEVKDVT
DTTALITWFKPLAEIDGIELTYGIKD-
VPGDRTTIDLTEDENQYSIGNLKPDTEYEVSLISRR
GDMSSNPAKETFTTGLDAPRNLR-
RVSQTDNSITLEWRNGKAAIDSYRIKYAPISGGDHA
EVDVPKSQQATTKTTLTG corresponding to amino acids 1-954 of TENA_HUMAN_V1 (SEQ ID NO: 1011), which also corresponds to amino acids 1-954 of HUMTEN_PEA_1_P30 (SEQ ID NO: 950), and a second amino acid sequence being at least 70%, optionally at least 80%, preferably at least 85%, more preferably at least 90% and most preferably at least 95% homologous to a polypeptide having the sequence ELCISASLSQPALEGP (SEQ ID NO: 1106) corresponding to amino acids 955-970 of HUMTEN_PEA_1_P30 (SEQ ID NO: 950), wherein said first amino acid sequence and second amino acid sequence are contiguous and in a sequential order.

According to preferred embodiments of the present invention, there is provided an isolated polypeptide encoding for a tail of HUMTEN_PEA_1_P30 (SEQ ID NO: 950), comprising a polypeptide being at least 70%, optionally at least about 80%, preferably at least about 85%, more preferably at least about 90% and most preferably at least about 95% homologous to the sequence ELCISASLSQPALEGP (SEQ ID NO: 1106) in HUMTEN_PEA_1_P30 (SEQ ID NO: 950).

According to preferred embodiments of the present invention, there is provided an isolated chimeric polypeptide encoding for HUMTEN_PEA_1_P31 (SEQ ID NO: 951), comprising a first amino acid sequence being at least 90% homologous to MGAMTQLLAGVFLAFLALATEGGV-
LKKVIRHKRQSGVNATLPEENQPVVFNHVYNIK
LPVGSQCSVDLESASGEKDLAPPSEPS-
ESFQEHTVDGENQIVFTHRINIPRRACGCAAAP
DVKELLSRLEELENLVSSLREQCTA-
GAGCCLQPATGRLDTRPFCSGRGNFSTEGCGCVC
EPGWKGPNCSEPECPGNCHLRGR-
CIDGQCICDDGFTGEDCSQLACPSDCNDQGKCVNG
VCICFEGYAGADCSREICPVPCSEEH-
GTCVDGLCVCHDGFAGDDCNKPLCLNNCYNRG
RCVENECVCDEGFTGEDCSELICPND-
CFDRGRCINGTCYCEEGFTGEDCGKPTCPHACH
TQGRCEEGQCVCDEGFAGVDCSEKRC-
PADCHNRGRCVDGRCECDDGFTGADCGELKC
PNGCSGHGRCVNGQCVCDEGYTGEDC-
SQLRCPNDCHSRGRCVEGKCVCEQGFKGYDC SDM-
SCPNDCHQHGRCVNGMCVCDDGYTGED-
CRDRQCPRDCSNRGLCVDGQCVCEDG
FTGPDCAELSCPNDCHGR-
GRCVNGQCVCHEGFMGKDCKEQRCPSD-
CHGQGRCVDGQ CICHEGFTGLDCGQHSCPSD-
CNNLGQCVSGRCICNEGYSGEDCSEVSPPKDLVVTE
VTE ETVNLAWDNEMRVTEYLVVYTPTHEG-
GLEMQFRVPGDQTSTIIQELEPGVEYFIRVFAI LEN-
KKSIPVSARVATYLPAPEGLKFK-
SIKETSVEVEWDPLDIAFETWEIIFRNMNKEDEG
EITKSLRRPETSYRQTGLAPGQEYEISL-
HIVKNNTRGPGLKRVTTTR corresponding to amino acids 1-802 of TENA_HUMAN_V1 (SEQ ID NO: 1011), which also corresponds to amino acids 1-802 of HUMTEN_PEA_1_P31 (SEQ ID NO: 951), and a second amino acid sequence being at least 70%, optionally at least 80%, preferably at least 85%, more preferably at least 90% and most preferably at least 95% homologous to a polypeptide having the sequence EYHL (SEQ ID NO: 1107) corresponding to amino acids 803-806 of HUMTEN_PEA_1_P31 (SEQ ID NO: 951), wherein said first amino acid sequence and second amino acid sequence are contiguous and in a sequential order.

According to preferred embodiments of the present invention, there is provided an isolated polypeptide encoding for a tail of HUMTEN_PEA_1_P31 (SEQ ID NO: 951), comprising a polypeptide being at least 70%, optionally at least about 80%, preferably at least about 85%, more preferably at least about 90% and most preferably at least about 95% homologous to the sequence EYHL (SEQ ID NO: 1107) in HUMTEN_PEA_1_P31 (SEQ ID NO: 951).

According to preferred embodiments of the present invention, there is provided an isolated chimeric polypeptide encoding for HUMTEN_PEA_1_P32 (SEQ ID NO: 952), comprising a first amino acid sequence being at least 90% homologous to MGAMTQLLAGVFLAFLALATEGGV-
LKKVIRHKRQSGVNATLPEENQPVVFNHVYNIK LPVGSQCSVDLESASGEKDLAPPSEPS-
ESFQEHTVDGENQIVFTHRINIPRRACGCAAAP
DVKELLSRLEELENLVSSLREQCTA-
GAGCCLQPATGRLDTRPFCSGRGNFSTEGCGCVC
EPGWKGPNCSEPECPGNCHLRGR-
CIDGQCICDDGFTGEDCSQLACPSDCNDQGKCVNG
VCICFEGYAGADCSREICPVPCSEEH-
GTCVDGLCVCHDGFAGDDCNKPLCLNNCYNRG
RCVENECVCDEGFTGEDCSELICPND-
CFDRGRCINGTCYCEEGFTGEDCGKPTCPHACH
TQGRCEEGQCVCDEGFAGVDCSEKRC-
PADCHNRGRCVDGRCECDDGFTGADCGELKC
PNGCSGHGRCVNGQCVCDEGYTGEDC-
SQLRCPNDCHSRGRCVEGKCVCEQGFKGYDC SDM-
SCPNDCHQHGRCVNGMCVCDDGYTGED-
CRDRQCPRDCSNRGLCVDGQCVCEDG
FTGPDCAELSCPNDCHGR-
GRCVNGQCVCHEGFMGKDCKEQRCPSD-
CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVAT corresponding to amino acids 1-710 of TENA_HUMAN_V1 (SEQ ID NO: 1011), which also corresponds to amino acids 1-710 of HUMTEN_PEA_1_P32 (SEQ ID NO: 952), and a second amino acid sequence being at least 70%, optionally at least 80%, preferably at least 85%, more preferably at least 90% and most preferably at least 95% homologous to a polypeptide having the sequence CE corresponding to amino acids 711-712 of HUMTEN_PEA_1_P32 (SEQ ID NO: 952), wherein said first amino acid sequence and second amino acid sequence are contiguous and in a sequential order.

According to preferred embodiments of the present invention, there is provided an isolated chimeric polypeptide encoding for HUMOSTRO_PEA_1_PEA_1_P21 (SEQ ID NO: 311), comprising a first amino acid sequence being at least 90% homologous to MRIAVICF-CLLGITCAIPVKQADSGSSEEKQ-LYNKYPDAVATWLNPDPSQKQNLLAPQ corresponding to amino acids 1-58 of OSTP_HUMAN, which also corresponds to amino acids 1-58 of HUMOSTRO_PEA_1_PEA_1_P21 (SEQ ID NO: 311), and a second amino acid sequence being at least 70%, optionally at least 80%, preferably at least 85%, more preferably at least 90% and most preferably at least 95% homologous to a polypeptide having the sequence VFLNFS (SEQ ID NO: 1108) corresponding to amino acids 59-64 of HUMOSTRO_PEA_1_PEA_1_P21 (SEQ ID NO: 311), wherein said first amino acid sequence and second amino acid sequence are contiguous and in a sequential order.

According to preferred embodiments of the present invention, there is provided an isolated polypeptide encoding for a tail of HUMOSTRO_PEA_1_PEA_1_P21 (SEQ ID NO: 311), comprising a polypeptide being at least 70%, optionally at least about 80%, preferably at least about 85%, more preferably at least about 90% and most preferably at least about 95% homologous to the sequence VFLNFS (SEQ ID NO: 1108) in HUMOSTRO_PEA_1_PEA_1_P21 (SEQ ID NO: 311).

According to preferred embodiments of the present invention, there is provided an isolated chimeric polypeptide encoding for HUMOSTRO_PEA_1_PEA_1_P25 (SEQ ID NO: 312), comprising a first amino acid sequence being at least 90% homologous to MRIAVICF-CLLGITCAIPVKQADSGSSEEKQ corresponding to amino acids 1-31 of OSTP_HUMAN, which also corresponds to amino acids 1-31 of HUMOSTRO_PEA_1_PEA_1_P25 (SEQ ID NO: 312), and a second amino acid sequence being at least 70%, optionally at least 80%, preferably at least 85%, more preferably at least 90% and most preferably at least 95% homologous to a polypeptide having the sequence H corresponding to amino acids 32-32 of HUMOSTRO_PEA_1_PEA_1_P25 (SEQ ID NO: 312), wherein said first amino acid sequence and second amino acid sequence are contiguous and in a sequential order.

According to preferred embodiments of the present invention, there is provided an isolated chimeric polypeptide encoding for HUMOSTRO_PEA_1_PEA_1_P30 (SEQ ID NO: 313), comprising a first amino acid sequence being at least 90% homologous to MRIAVICF-CLLGITCAIPVKQADSGSSEEKQ corresponding to amino acids 1-31 of OSTP_HUMAN, which also corresponds to amino acids 1-31 of HUMOSTRO_PEA_1_PEA_1_P30 (SEQ ID NO: 313), and a second amino acid sequence being at least 70%, optionally at least 80%, preferably at least 85%, more preferably at least 90% and most preferably at least 95% homologous to a polypeptide having the sequence VSIFYVFI (SEQ ID NO: 1109) corresponding to amino acids 32-39 of HUMOSTRO_PEA_1_PEA_1_P30 (SEQ ID NO: 313), wherein said first amino acid sequence and second amino acid sequence are contiguous and in a sequential order.

According to preferred embodiments of the present invention, there is provided an isolated polypeptide encoding for a tail of HUMOSTRO_PEA_1_PEA_1_P30 (SEQ ID NO: 313), comprising a polypeptide being at least 70%, optionally at least about 80%, preferably at least about 85%, more preferably at least about 90% and most preferably at least about 95% homologous to the sequence VSIFYVFI (SEQ ID NO: 1109) in HUMOSTRO_PEA_1_PEA_1_P30 (SEQ ID NO: 313).

According to preferred embodiments of the present invention, there is provided an isolated chimeric polypeptide encoding for H61775_P16 (SEQ ID NO: 9), comprising a first amino acid sequence being at least 90% homologous to MVWCLGLAVLSLVISQGADGRGKPEVVS-VVGRAGESVVLGCDLLPPAGRPPLHVIEWL RFGFLL-PIFIQFGLYSPRIDPDYVG corresponding to amino acids 11-93 of Q9P2J2 (SEQ ID NO: 953), which also corresponds to amino acids 1-83 of H61775_P16 (SEQ ID NO: 9), and a second amino acid sequence being at least 70%, optionally at least 80%, preferably at least 85%, more preferably at least 90% and most preferably at least 95% homologous to a polypeptide having the sequence DCGFPAFRELKRA-ETVSPVFFTRRCIWEDLKSTGF-SPAGGGRPPGGGPRTQEDSGLPCW RSSCSVTLQV (SEQ ID NO: 1110) corresponding to amino acids 84-152 of H61775_P16 (SEQ ID NO: 9), wherein said first and second amino acid sequences are contiguous and in a sequential order.

According to preferred embodiments of the present invention, there is provided an isolated polypeptide encoding for a tail of H61775_P16 (SEQ ID NO: 9), comprising a polypeptide being at least 70%, optionally at least about 80%, preferably at least about 85%, more preferably at least about 90% and most preferably at least about 95% homologous to the sequence DCGFPAFRELKRAETVSPVFFTRRCIW-EDLKSTGFSPAGGGRPPGGGPRTQEDSGLPCW RSSCSVTLQV (SEQ ID NO: 1110) in H61775_P16 (SEQ ID NO: 9).

According to preferred embodiments of the present invention, there is provided an isolated chimeric polypeptide encoding for H61775_P16 (SEQ ID NO: 9), comprising a first amino acid sequence being at least 90% homologous to MVWCLGLAVLSLVISQGADGRGKPEVVS-VVGRAGESVVLGCDLLPPAGRPPLHVIEWL RFGFLL-PIFIQFGLYSPRIDPDYVG corresponding to amino acids 1-83 of AAQ88495 (SEQ ID NO: 954), which also corresponds to amino acids 1-83 of H61775_P16 (SEQ ID NO: 9), and a second amino acid sequence being at least 70%, optionally at least 80%, preferably at least 85%, more preferably at least 90% and most preferably at least 95% homologous to a polypeptide having the sequence DCGFPAFRELKRA-ETVSPVFFTRRCIWEDLKSTGF-SPAGGGRPPGGGPRTQEDSGLPCW RSSCSVTLQV (SEQ ID NO: 1110) corresponding to amino acids 84-152 of H61775_P16 (SEQ ID NO: 9), wherein said first and second amino acid sequences are contiguous and in a sequential order.

According to preferred embodiments of the present invention, there is provided an isolated polypeptide encoding for a tail of H61775_P16 (SEQ ID NO: 9), comprising a polypeptide being at least 70%, optionally at least about 80%, preferably at least about 85%, more preferably at least about 90% and most preferably at least about 95% homologous to the sequence DCGFPAFRELKRAETVSPVFFTRRCIW-EDLKSTGFSPAGGGRPPGGGPRTQEDSGLPCW RSSCSVTLQV (SEQ ID NO: 1110) in H61775_P16 (SEQ ID NO: 9).

According to preferred embodiments of the present invention, there is provided an isolated chimeric polypeptide encoding for H61775_P17 (SEQ ID NO: 10), comprising a first amino acid sequence being at least 90% homologous to MVWCLGLAVLSLVISQGADGRGKPEVVS-VVGRAGESVVLGCDLLPPAGRPPLHVIEWL RFGFLL-PIFIQFGLYSPRIDPDYVG corresponding to amino acids 11-93 of Q9P2J2 (SEQ ID NO: 953), which also corresponds to amino acids 1-83 of H61775_P17 (SEQ ID NO: 10).

According to preferred embodiments of the present invention, there is provided an isolated chimeric polypeptide encoding for H61775_P17 (SEQ ID NO: 10), comprising a first amino acid sequence being at least 90% homologous to MVWCLGLAVLSLVISQGADGRGKPEVVS-VVGRAGESVVLGCDLLPPAGRPPLHVIEWL RFGFLL-PIFIQFGLYSPRIDPDYVG corresponding to amino acids 1-83 of AAQ88495 (SEQ ID NO: 954), which also corresponds to amino acids 1-83 of H61775_P17 (SEQ ID NO: 10).

According to preferred embodiments of the present invention, there is provided an isolated chimeric polypeptide encoding for HSAPHOL_P2 (SEQ ID NO: 37), comprising a first amino acid sequence being at least 70%, optionally at least 80%, preferably at least 85%, more preferably at least 90% and most preferably at least 95% homologous to a polypeptide having the sequence PHSGPAAAFIRRRGWW-PGPRCA (SEQ ID NO: 1111) corresponding to amino acids 1-22 of HSAPHOL_P2 (SEQ ID NO: 37), second amino acid sequence being at least 90% homologous to PATPRPLSWL-RAPTRLCLDGPSPVLCA corresponding to amino acids 1-27 of AAH21289, which also corresponds to amino acids 23-49 of HSAPHOL_P2 (SEQ ID NO: 37), and a third amino acid sequence being at least 90% homologous to EKEKDP-KYWRDQAQETLKYALELQKLNTNVAKN-VIMFLGDGMGVSTVTAARILKGQL HHNPGEETR-LEMDKFPFVALSKTYNTNAQVPDSAGTATAYLCGVK ANEGTVGVSAAT ERSRCNTTQGNEVTSILR-WAKDAGKSVGIVTTTRVNHATPSAAYAH-SADRDWYSDNE MPPEALSQGCKDIAYQLMHNIRD-IDVIMGGGRKYMYPKNKTDVEYESDEKARGTRLD GLDLVDTWKSFKPRYKHSHFIWNR-TELLTLDPHNVDYLLGLFEPGDMQYELNRNNVT DPSLSEMVVVAIQILRKNPKGFFLLVEG-GRIDHGHHEGKAKQALHEAVEMDRAIGQAG SLTSSEDTLTVVTADHSHVFTFGGYT-PRGNSIFGLAPMLSDTDKKPFTAILYGNGPGYK VVG-GERENVSMVDYAHNNYQAQSAVPL-RHETHGGEDVAVFSKGPMAHLLHGVHEQN YVPHVMAYAACIGANLGHCAPASSAGS-LAAGPLLLALALYPLSVLF corresponding to amino acids 83-586 of AAH21289, which also corresponds to amino acids 50-553 of HSAPHOL_P2 (SEQ ID NO: 37), wherein said first, second and third amino acid sequences are contiguous and in a sequential order.

According to preferred embodiments of the present invention, there is provided an isolated polypeptide encoding for a head of HSAPHOL_P2 (SEQ ID NO: 37), comprising a polypeptide being at least 70%, optionally at least about 80%, preferably at least about 85%, more preferably at least about 90% and most preferably at least about 95% homologous to the sequence PHSGPAAAFIRRRGWWPGPRCA (SEQ ID NO: 1111) of HSAPHOL_P2 (SEQ ID NO: 37).

According to preferred embodiments of the present invention, there is provided an isolated chimeric polypeptide encoding for an edge portion of HSAPHOL_P2 (SEQ ID NO: 37), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AE, having a structure as follows: a sequence starting from any of amino acid numbers 49−x to 50; and ending at any of amino acid numbers 50+((n−2)−x), in which x varies from 0 to n−2.

According to preferred embodiments of the present invention, there is provided an isolated chimeric polypeptide encoding for HSAPHOL_P2 (SEQ ID NO: 37), comprising a first amino acid sequence being at least 70%, optionally at least 80%, preferably at least 85%, more preferably at least 90% and most preferably at least 95% homologous to a polypeptide having the sequence PHSGPAAAFIRRRGWW-PGPRCAPATPRPLSWLRAPTRLCLDGPSPVLCA corresponding to amino acids 1-49 of HSAPHOL_P2 (SEQ ID NO: 37), second amino acid sequence being at least 90% homologous to EKEKDPKYWRDQAQETLKY-ALELQKLNTNVAKNVIMFLGDG-MGVSTVTAARILKGQL HHNPGEETRLEMDKF-PFVALSKTYNTNAQVPDSAGTATAYLCGVKANEGTV GVSAAT ERSRCNTTQGNEVTSILRWAKDAGKSV-GIVTTTRVNHATPSAAYAHSADRDWYSDNE MPPEALSQGCKDIAYQLMHNIRDID-VIMGGGRKYMYPKNKTDVEYESDEKARGTRLD GLDLVDTWKSFKPRYKHSHFIWNR-TELLTLDPHNVDYLLGLFEPGDMQYELNRNNVT DPSLSEMVVVAIQILRKNPKGFFLLVEG-GRIDHGHHEGKAKQALHEAVEMDRAIGQAG SLTSSEDTLTVVTADHSHVFTFGGYT-PRGNSIFGLAPMLSDTDKKPFTAILYGNGPGYK VVG-GERENVSMVDYAHNNYQAQSAVPL-RHETHGGEDVAVFSKGPMAHLLHGVHEQN YVPHVMAYAACIGANLGHCAPASSAGS-LAAGPLLLALALYPLSVLF corresponding to amino acids 21-524 of PPBT_HUMAN, which also corresponds to amino acids 50-553 of HSAPHOL_P2 (SEQ ID NO: 37), wherein said first, second and third amino acid sequences are contiguous and in a sequential order.

According to preferred embodiments of the present invention, there is provided an isolated polypeptide encoding for a head of HSAPHOL_P2 (SEQ ID NO: 37), comprising a polypeptide being at least 70%, optionally at least about 80%, preferably at least about 85%, more preferably at least about 90% and most preferably at least about 95% homologous to the sequence PHSGPAAAFIRRRGWWPGPRCAPAT-PRPLSWLRAPTRLCLDGPSPVLCA of HSAPHOL_P2 (SEQ ID NO: 37).

According to preferred embodiments of the present invention, there is provided an isolated chimeric polypeptide encoding for an edge portion of HSAPHOL_P2 (SEQ ID NO: 37), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AE, having a structure as follows: a sequence starting from any of amino acid numbers 49–x to 50; and ending at any of amino acid numbers 50+((n−2)−x), in which x varies from 0 to n−2.

According to preferred embodiments of the present invention, there is provided an isolated chimeric polypeptide encoding for HSAPHOL_P3 (SEQ ID NO: 38), comprising a first amino acid sequence being at least 90% homologous to MISPFLVLAIGTCLTNSLVP corresponding to amino acids 63-82 of AAH21289, which also corresponds to amino acids 1-20 of HSAPHOL_P3 (SEQ ID NO: 38), and a second amino acid sequence being at least 90% homologous to GMGVSTVTAARILKGQLHHNPGEETR-LEMDKFPFVALSKTYNTNAQVPDSAGTATAYL CGV-KANEGTVGVSAATERSRCNT-TQGNEVTSILRWAKDAGKSVGIVTTTRVNHATPSA AYAHSADRDWYSDNEMPPEALSQGCKDI-AYQLMHNIRDIDVIMGGGRKYMYPKNKTD VEYES-DEKARGTRLDGLDLVDTWKSFKPRYKHS-HFIWNRTELLTLDPHNVDYLLGLFE PGDMQYELNRNNVTDPSLSEMVVVAI-QILRKNPKGFFLLVEGGRIDHGHHEGKAKQAL HEAVEMDRAIGQAGSLTSSEDTLTV-VTADHSHVFTFGGYTPRGNSIFGLAPMLSDTDKK PFTAILYGNGPGYKVVGGERENVSM-VDYAHNNYQAQSAVPLRHETHGGEDVAVFSKG PMAHLLHGVHEQNYVPHVMAYAACIGAN-LGHCAPASSAGSLAAGPLLLALALYPLSV LF corresponding to amino acids 123-586 of AAH21289, which also corresponds to amino acids 21-484 of HSAPHOL_P3 (SEQ ID NO: 38), wherein said first and second amino acid sequences are contiguous and in a sequential order.

According to preferred embodiments of the present invention, there is provided an isolated chimeric polypeptide encoding for an edge portion of HSAPHOL_P3 (SEQ ID NO: 38), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PG, having a structure as follows: a sequence starting from any of amino acid numbers 20−x to 20; and ending at any of amino acid numbers 21+((n−2)−x), in which x varies from 0 to n−2.

According to preferred embodiments of the present invention, there is provided an isolated chimeric polypeptide encoding for HSAPHOL_P3 (SEQ ID NO: 38), comprising a first amino acid sequence being at least 90% homologous to MISPFLVLAIGTCLTNSLVP corresponding to amino acids 1-20 of PPBT_HUMAN, which also corresponds to amino acids 1-20 of HSAPHOL_P3 (SEQ-ID NO: 38), and a second amino acid sequence being at least 90% homologous to GMGVSTVTAARILKGQLHHNPGEETR-LEMDKFPFVALSKTYNTNAQVPDSAGTATAYL CGV-KANEGTVGVSAATERSRCNT-TQGNEVTSILRWAKDAGKSVGIVTTTRVNHATPSA AYAHSADRDWYSDNEMPPEALSQGCKDI-AYQLMHNIRDIDVIMGGGRKYMYPKNKTD VEYES-DEKARGTRLDGLDLVDTWKSFKPRYKHS-HFIWNRTELLTLDPHNVDYLLGLFE PGDMQYELNRNNVTDPSLSEMVVVAI-QILRKNPKGFFLLVEGGRIDHGHHEGKAKQAL HEAVEMDRAIGQAGSLTSSEDTLTV-VTADHSHVFTFGGYTPRGNSIFGLAPMLSDTDKK PFTAILYGNGPGYKVVGGERENVSM-VDYAHNNYQAQSAVPLRHETHGGEDVAVFSKG PMAHLLHGVHEQNYVPHVMAYAACIGAN-LGHCAPASSAGSLAAGPLLLALALYPLSV LF corresponding to amino acids 61-524 of PPBT_HUMAN, which also corresponds to amino acids 21-484 of HSAPHOL_P3 (SEQ ID NO: 38), wherein said first and second amino acid sequences are contiguous and in a sequential order.

According to preferred embodiments of the present invention, there is provided an isolated chimeric polypeptide encoding for an edge portion of HSAPHOL_P3 (SEQ ID NO: 38), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PG, having a structure as follows: a sequence starting from any of amino acid numbers 20−x to 20; and ending at any of amino acid numbers 21+((n−2)−x), in which x varies from 0 to n−2.

According to preferred embodiments of the present invention, there is provided an isolated chimeric polypeptide encoding for HSAPHOL_P4 (SEQ ID NO: 39), comprising a first amino acid sequence being at least 90% homologous to MGVSTVTAARILKGQLHHNPGEETRLEM-DKFPFVALSKTYNTNAQVPDSAGTATAYLC GVKANEGTVGVSAATERSRCNT-TQGNEVTSILRWAKDAGKSVGIVTTTRVNHATPSAA YAHSADRDWYSDNEMPPEALSQGCKDI-AYQLMHNIRDIDVIMGGGRKYMYPKNKTDV EYES-DEKARGTRLDGLDLVDTWKSFKPRYKHS-HFIWNRTELLTLDPHNVDYLLGLFEP GDMQYELNRNNVTDPSLSEMVVAIQIL-RKNPKGFFLLVEGGRIDHGHHEGKAKQALH EAVEM-DRAIGQAGSLTSSEDTLTVVTADHSH-VFTFGGYTPRGNSIFGLAPMLSDTDKKP FTAILYGNGPGYKVVGGERENVSM-VDYAHNNYQAQSAVPLRHETHGGEDVAVFSKGP MAHLLHGVHEQNYVPHVMAYAACIGAN-LGHCAPASSAGSLAAGPLLLALALYPLSVL F corresponding to amino acids 124-586 of AAH21289, which also corresponds to amino acids 1-463 of HSAPHOL_P4 (SEQ ID NO: 39).

According to preferred embodiments of the present invention, there is provided an isolated chimeric polypeptide encoding for HSAPHOL_P4 (SEQ ID NO: 39), comprising a first amino acid sequence being at least 90% homologous to MGVSTVTAARILKGQLHHNPGEETRLEM-DKFPFVALSKTYNTNAQVPDSAGTATAYLC GVKANEGTVGVSAATERSRCNT-TQGNEVTSILRWAKDAGKSVGIVTTTRVNHATPSAA YAHSADRDWYSDNEMPPEALSQGCKDI- AYQLMHNIRDIDVIMGGGRKYMYPKNKTDV EYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALH EAVEMDRAIGQAGSLTSSEDTLTVVTADHSHVFTFGGYTPRGNSIFGLAPMLSDTDKKP FTAILYGNGPGYKVVGGERENVSMVDYAHNNYQAQSAVPLRHETHGGEDVAVFSKGP MAHLLHGVHEQNYVPHVMAYAACIGANLGHCAPASSAGSLAAGPLLLALALYPLSVL F corresponding to amino acids 62-524 of PPBT_HUMAN, which also corresponds to amino acids 1-463 of HSAPHOL_P4 (SEQ ID NO: 39).

According to preferred embodiments of the present invention, there is provided an isolated chimeric polypeptide encoding for HSAPHOL_P5 (SEQ ID NO: 40), comprising a first amino acid sequence being at least 90% homologous to MISPFLVLAIGTCLTNSLVPEKEKDPKYWRDQAQETLKYALELQKLNTNVAKNVIMFL GDGMGVSTVTAARILKGQLHHNPGEETRLEMDKFPFVALSKTYNTNAQVPDSAGTAT AYLCGVKANEGTVGVSAATERSRCNTTQGNEVTSILRWAKDAGKSVGIVTTTRVNHA TPSAAYAHSADRDWYSDNEMPPEALSQGCKDIAYQLMHNIRDIDVIMGGGRKYMYPK NKTDVEYESDEKARGTRLDGLDLVDTWKSFKPRYKHSHFIWNRTELLTLDPHNVDYLL GLFEPGDMQYELNRNNVTDPSLSEMVVVAIQILRKNPKGFFLLVEGGRIDHGHHEGKA KQALHEAVEM corresponding to amino acids 63-417 of AAH21289, which also corresponds to amino acids 1-355 of HSAPHOL_P5 (SEQ ID NO: 40), and a second amino acid sequence being at least 90% homologous to DHSHVFTFGGYTPRGNSIFGLAPMLSDTDKKPFTAILYGNGPGYKVVGGERENVSMVD YAHNNYQAQSAVPLRHETHGGEDVAVFSKGPMAHLLHGVHEQNYVPH VMAYAACIG ANLGHCAPASSAGSLAAGPLLLALALYPLSVLF corresponding to amino acids 440-586 of AAH21289, which also corresponds to amino acids 356-502 of HSAPHOL_P5 (SEQ ID NO: 40), wherein said first and second amino acid sequences are contiguous and in a sequential order.

According to preferred embodiments of the present invention, there is provided an isolated chimeric polypeptide encoding for an edge portion of HSAPHOL_P5 (SEQ ID NO: 40), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise MD, having a structure as follows: a sequence starting from any of amino acid numbers 355−x to 355; and ending at any of amino acid numbers 356+((n−2)−x), in which x varies from 0 to n−2.

According to preferred embodiments of the present invention, there is provided an isolated chimeric polypeptide encoding for HSAPHOL_P5 (SEQ ID NO: 40), comprising a first amino acid sequence being at least 90% homologous to MISPFLVLAIGTCLTNSLVPEKEKDPKYWRDQAQETLKYALELQKLNTNVAKNVIMFL GDGMGVSTVTAARILKGQLHHNPGEETRLEMDKFPFVALSKTYNTNAQVPDSAGTAT AYLCGVKANEGTVGVSAATERSRCNTTQGNEVTSILRWAKDAGKSVGIVTTTRVNHA TPSAAYAHSADRDWYSDNEMPPEALSQGCKDIAYQLMHNIRDIDVIMGGGRKYMYPK NKTDVEYESDEKARGTRLDGLDLVDTWKSFKPRYKHSHFIWNRTELLTLDPHNVDYLL GLFEPGDMQYELNRNNVTDPSLSEMVVVAIQILRKNPKGFFLLVEGGRIDHGHHEGKA KQALHEAVEM corresponding to amino acids 1-355 of PPBT_HUMAN, which also corresponds to amino acids 1-355 of HSAPHOL_P5 (SEQ ID NO: 40), and a second amino acid sequence being at least 90% homologous to DHSHVFTFGGYTPRGNSIFGLAPMLSDTDKKPFTAILYGNGPGYKVVGGERENVSMVD YAHNNYQAQSAVPLRHETHGGEDVAVFSKGPMAHLLHGVHEQNYVPHVMAYAACIG ANLGHCAPASSAGSLAAGPLLLALALYPLSVLF corresponding to amino acids 377-524 of PPBT_HUMAN, which also corresponds to amino acids 356-502 of HSAPHOL_P5 (SEQ ID NO: 40), wherein said first and second amino acid sequences are contiguous and in a sequential order.

According to preferred embodiments of the present invention, there is provided an isolated chimeric polypeptide encoding for an edge portion of HSAPHOL_P5 (SEQ ID NO: 40), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise MD, having a structure as follows: a sequence starting from any of amino acid numbers 355−x to 355; and ending at any of amino acid numbers 356+((n−2)−x), in which x varies from 0 to n−2.

According to preferred embodiments of the present invention, there is provided an isolated chimeric polypeptide encoding for HSAPHOL_P6 (SEQ ID NO: 41), comprising a first amino acid sequence being at least 90% homologous to MISPFLVLAIGTCLTNSLVPEKEKDPKYWRDQAQETLKYALELQKLNTNVAKNVIMFL GDGMGVSTVTAARILKGQLHHNPGEETRLEMDKFPFVALSKTYNTNAQVPDSAGTAT AYLCGVKANEGTVGVSAATERSRCNTTQGNEVTSILRWAKDAGKSVGIVTTTRVNHA TPSAAYAHSADRDWYSDNEMPPEALSQGCKDIAYQLMHNIRDIDVIMGGGRKYMYPK NKTDVEYESDEKARGTRLDGLDLVDTWKSFKPRYKHSHFIWNRTELLTLDPHNVDYLL corresponding to amino acids 63-349 of AAH21289, which also corresponds to amino acids 1-287 of HSAPHOL_P6 (SEQ ID NO: 41), and a second amino acid sequence being at least 90% homologous to GGRIDHGHHEGKAKQALHEAVEMDRAIGQAGSLTSSEDTLTVVTADHSHVFTFGGYTP RGNSIFGLAPMLSDTDKKPFTAILYGNGPGYKVVGGERENVSMVDYAHNNY QAQSAV PLRHETHGGEDVAVFSKGPMAHLLHGVHEQNYVPHVMAYAACIGANLGHCAPASSAG SLAAGPLLLALALYPLSVLF corresponding to amino acids 395-586 of AAH21289, which also corresponds to amino acids 288-479 of HSAPHOL_P6 (SEQ ID NO: 41), wherein said first and second amino acid sequences are contiguous and in a sequential order.

According to preferred embodiments of the present invention, there is provided an isolated chimeric polypeptide encoding for an edge portion of HSAPHOL_P6 (SEQ ID NO: 41), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 287−x to 287; and ending at any of amino acid numbers 288+((n−2)−x), in which x varies from 0 to n−2.

According to preferred embodiments of the present invention, there is provided an isolated chimeric polypeptide encoding for HSAPHOL_P6 (SEQ ID NO: 41), comprising a first amino acid sequence being at least 90% homologous to MISPFLVLAIGTCLTNSLVPEKEKDPKYWRDQAQETLKYALELQKLNTNVAKNVIMFL GDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLL corresponding to amino acids 1-287 of PPBT_HUMAN, which also corresponds to amino acids 1-287 of HSAPHOL_P6 (SEQ ID NO: 41), and a second amino acid sequence being at least 90% homologous to GGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF corresponding to amino acids 333-524 of PPBT_HUMAN, which also corresponds to amino acids 288-479 of HSAPHOL_P6 (SEQ ID NO: 41), wherein said first and second amino acid sequences are contiguous and in a sequential order.

According to preferred embodiments of the present invention, there is provided an isolated chimeric polypeptide encoding for an edge portion of HSAPHOL_P6 (SEQ ID NO: 41), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 287−x to 287; and ending at any of amino acid numbers 288+((n−2)−x), in which x varies from 0 to n−2.

According to preferred embodiments of the present invention, there is provided an isolated chimeric polypeptide encoding for HSAPHOL_P7 (SEQ ID NO: 42), comprising a first amino acid sequence being at least 90% homologous to MISPFLVLAIGTCLTNSLVPEKEKDPKYWRDQAQETLKYALELQKLNTNVAKNVIMFL GDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYK corresponding to amino acids 63-326 of AAH21289, which also corresponds to amino acids 1-264 of HSAPHOL_P7 (SEQ ID NO: 42), and a second amino acid sequence being at least 70%, optionally at least 80%, preferably at least 85%, more preferably at least 90% and most preferably at least 95% homologous to a polypeptide having the sequence LPPRCPLANRVDFSWAGREYRLQTFSKPLIFLANVFLQTQRP (SEQ ID NO: 1112) corresponding to amino acids 265-306 of HSAPHOL_P7 (SEQ ID NO: 42), wherein said first and second amino acid sequences are contiguous and in a sequential order.

According to preferred embodiments of the present invention, there is provided an isolated polypeptide encoding for a tail of HSAPHOL_P7 (SEQ ID NO: 42), comprising a polypeptide being at least 70%, optionally at least about 80%, preferably at least about 85%, more preferably at least about 90% and most preferably at least about 95% homologous to the sequence LPPRCPLANRVDFSWAGREYRLQTFSKPLIFLANVFLQTQRP (SEQ ID NO: 1112) in HSAPHOL_P7 (SEQ ID NO: 42).

According to preferred embodiments of the present invention, there is provided an isolated chimeric polypeptide encoding for HSAPHOL_P7 (SEQ ID NO: 42), comprising a first amino acid sequence being at least 90% homologous to MISPFLVLAIGTCLTNSLVPEKEKDPKYWRDQAQETLKYALELQKLNTNVAKNVIMFL GDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPR corresponding to amino acids 1-262 of PPBT_HUMAN, which also corresponds to amino acids 1-262 of HSAPHOL_P7 (SEQ ID NO: 42), and a second amino acid sequence being at least 70%, optionally at least 80%, preferably at least 85%, more preferably at least 90% and most preferably at least 95% homologous to a polypeptide having the sequence YKLPPRCPLANRVDFSWAGREYRLQTFSKPLIFLANVFLQTQRP corresponding to amino acids 263-306 of HSAPHOL_P7 (SEQ ID NO: 42), wherein said first and second amino acid sequences are contiguous and in a sequential order.

According to preferred embodiments of the present invention, there is provided an isolated polypeptide encoding for a tail of HSAPHOL_P7 (SEQ ID NO: 42), comprising a polypeptide being at least 70%, optionally at least about 80%, preferably at least about 85%, more preferably at least about 90% and most preferably at least about 95% homologous to the sequence YKLPPRCPLANRVDFSWAGREYRLQTFSKPLIFLANVFLQTQRP in HSAPHOL_P7 (SEQ ID NO: 42).

According to preferred embodiments of the present invention, there is provided an isolated chimeric polypeptide encoding for HSAPHOL_P7 (SEQ ID NO: 42), comprising a first amino acid sequence being at least 90% homologous to MISPFLVLAIGTCLTNSLVPEKEKDPKYWRDQAQETLKYALELQKLNTNVAKNVIMFL GDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYK corresponding to amino acids 1-264 of O75090 (SEQ ID NO: 958), which also corresponds to amino acids 1-264 of HSAPHOL_P7 (SEQ ID NO: 42), and a second amino acid sequence being at least 70%, optionally at least 80%, preferably at least 85%, more preferably at least 90% and most preferably at least 95% homologous to a polypeptide having the sequence LPPRCPLANRVDFSWAGREYRLQTFSKPLIFLANVFLQTQRP (SEQ ID NO: 1112) corresponding to amino acids 265-306 of HSAPHOL_P7 (SEQ ID NO: 42), wherein said first and second amino acid sequences are contiguous and in a sequential order.

According to preferred embodiments of the present invention, there is provided an isolated polypeptide encoding for a tail of HSAPHOL_P7 (SEQ ID NO: 42), comprising a polypeptide being at least 70%, optionally at least about 80%, preferably at least about 85%, more preferably at least about 90% and most preferably at least about 95% homologous to the sequence LPPRCPLANRVDFSWAGREYRLQTFSKP-LIFLANVFLQTQRP (SEQ ID NO: 1112) in HSAPHOL_P7 (SEQ ID NO: 42).

According to preferred embodiments of the present invention, there is provided an isolated chimeric polypeptide encoding for HSAPHOL_P8 (SEQ ID NO: 43), comprising a first amino acid sequence being at least 90% homologous to MISPFLVLAIGTCLTNSLVPEKEKDPKY-WRDQAQETLKYALELQKLNTNVAKNVIMFL GDG-MGVSTVTAARILKGQLHHNPGEETRLEM-DKFPFVALSKTYNTNAQVPDSAGTAT AYLCGVKANEGTVGVSAATERSRCNT-TQGNEVTSILRWAKDAGKSVGIVTTTRVNHA TPSAAYAHSADRDWYSDNEMP-PEALSQGCKDIAYQLMHNIRDIDVIMGGGRKYMYPK NKTDVEYESDEKARGTRLDGLD-LVDTWKSFKPRYKHSHFIWNRTELLTLDPHNVDYLL G corresponding to amino acids 63-350 of AAH21289, which also corresponds to amino acids 1-288 of HSAPHOL_P8 (SEQ ID NO: 43), and a second amino acid sequence being at least 70%, optionally at least 80%, preferably at least 85%, more preferably at least 90% and most preferably at least 95% homologous to a polypeptide having the sequence KWRG-WRGGCMARSLVAGAACGQHLGTRP (SEQ ID NO: 1113) corresponding to amino acids 289-316 of HSA-PHOL_P8 (SEQ ID NO: 43), wherein said first and second amino acid sequences are contiguous and in a sequential order.

According to preferred embodiments of the present invention, there is provided an isolated polypeptide encoding for a tail of HSAPHOL_P8 (SEQ ID NO: 43), comprising a polypeptide being at least 70%, optionally at least about 80%, preferably at least about 85%, more preferably at least about 90% and most preferably at least about 95% homologous to the sequence KWRGWRGGCMARSLVA-GAACGQHLGTRP (SEQ ID NO: 1113) in HSAPHOL_P8 (SEQ ID NO: 43).

According to preferred embodiments of the present invention, there is provided an isolated chimeric polypeptide encoding for HSAPHOL_P8 (SEQ ID NO: 43), comprising a first amino acid sequence being at least 90% homologous to MISPFLVLAIGTCLTNSLVPEKEKDPKY-WRDQAQETLKYALELQKLNTNVAKNVIMFL GDG-MGVSTVTAARILKGQLHHNPGEETRLEM-DKFPFVALSKTYNTNAQVPDSAGTAT AYLCGVKANEGTVGVSAATERSRCNT-TQGNEVTSILRWAKDAGKSVGIVTTTRVNHA TPSAAYAHSADRDWYSDNEMP-PEALSQGCKDIAYQLMHNIRDIDVIMGGGRKYMYPK NKTDVEYESDEKARGTRLDGLD-LVDTWKSFKPRYKHSHFIWNRTELLTLDPHNVDYLL G corresponding to amino acids 1-288 of PPBT_HUMAN, which also corresponds to amino acids 1-288 of HSA-PHOL_P8 (SEQ ID NO: 43), and a second amino acid sequence being at least 70%, optionally at least 80%, preferably at least 85%, more preferably at least 90% and most preferably at least 95% homologous to a polypeptide having the sequence KWRGWRGGCMARSLVA-GAACGQHLGTRP (SEQ ID NO: 1113) corresponding to amino acids 289-316 of HSAPHOL_P8 (SEQ ID NO: 43), wherein said first and second amino acid sequences are contiguous and in a sequential order.

According to preferred embodiments of the present invention, there is provided an isolated polypeptide encoding for a tail of HSAPHOL_P8 (SEQ ID NO: 43), comprising a polypeptide being at least 70%, optionally at least about 80%, preferably at least about 85%, more preferably at least about 90% and most preferably at least about 95% homologous to the sequence KWRGWRGGCMARSLVA-GAACGQHLGTRP (SEQ ID NO: 1113) in HSAPHOL_P8 (SEQ ID NO: 43).

According to preferred embodiments of the present invention, there is provided an isolated chimeric polypeptide encoding for HSAPHOL_P8 (SEQ ID NO: 43), comprising a first amino acid sequence being at least 90% homologous to MISPFLVLAIGTCLTNSLVPEKEKDPKY-WRDQAQETLKYALELQKLNTNVAKNVIMFL GDG-MGVSTVTAARILKGQLHHNPGEETRLEM-DKFPFVALSKTYNTNAQVPDSAGTAT AYLCGVKANEGTVGVSAATERSRCNT-TQGNEVTSILRWAKDAGKSVGIVTTTRVNHA TPSAAYAHSADRDWYSDNEMP-PEALSQGCKDIAYQLMHNIRDIDVIMGGGRKYMYPK NKTDVEYESDEKARGTRLDGLD-LVDTWKSFKPRYKHSHFIWNRTELLTLDPHNVDYLL G corresponding to amino acids 1-288 of O75090 (SEQ ID NO: 958), which also corresponds to amino acids 1-288 of HSAPHOL_P8 (SEQ ID NO: 43), and a second amino acid sequence being at least 70%, optionally at least 80%, preferably at least 85%, more preferably at least 90% and most preferably at least 95% homologous to a polypeptide having the sequence KWRGWRGGCMARSLVA-GAACGQHLGTRP (SEQ ID NO: 1113) corresponding to amino acids 289-316 of HSAPHOL_P8 (SEQ ID NO: 43), wherein said first and second amino acid sequences are contiguous and in a sequential order.

According to preferred embodiments of the present invention, there is provided an isolated polypeptide encoding for a tail of HSAPHOL_P8 (SEQ ID NO: 43), comprising a polypeptide being at least 70%, optionally at least about 80%, preferably at least about 85%, more preferably at least about 90% and most preferably at least about 95% homologous to the sequence KWRGWRGGCMARSLVA-GAACGQHLGTRP (SEQ ID NO: 1113) in HSAPHOL_P8 (SEQ ID NO: 43).

According to preferred embodiments of the present invention, there is provided an isolated chimeric polypeptide encoding for T10888_PEA_1_P2 (SEQ ID NO: 57), comprising a first amino acid sequence being at least 90% homologous to MGPPSAPPCRLHVPWKEVLLTASLLTF-WNPPTTAKLTIESTPFNVAEGKEVLLLAHNLP QNRI-GYSWYKGERVDGNSLIVGYVIGTQQAT-PGPAYSGRETIYPNASLLIQNVTQNDTG FYTLQVIKSDLVNEEATGQFHVYPELP-KPSISSNNSNPVEDKDAVAFTCEPEVQNTTYL WWVNGQSLPVSPRLQLSNGNMTLTLLS-VKRNDAGSYECEIQNPASANRSDPVTLNVLY GPDVP-TISPSKANYRPGENLNLSCHAASNP-PAQYSWFINGTFQQSTQELFIPNITVNNSGS YMCQAHNSATGLNRTTVTMITVS corresponding to amino acids 1-319 of CEA6_HUMAN, which also corresponds to amino acids 1-319 of T10888_PEA_1_P2 (SEQ ID NO: 57), and a second amino acid sequence being at least 70%, optionally at least 80%, preferably at least 85%, more preferably at least 90% and most preferably at least 95% homologous to a polypeptide having the sequence DWTRP (SEQ ID NO: 1114) corresponding to amino acids 320-324 of T10888_PEA_1_P2 (SEQ ID NO: 57), wherein said first and second amino acid sequences are contiguous and in a sequential order.

According to preferred embodiments of the present invention, there is provided an isolated polypeptide encoding for a tail of T10888_PEA_1_P2 (SEQ ID NO: 57), comprising a polypeptide being at least 70%, optionally at least about 80%, preferably at least about 85%, more preferably at least about 90% and most preferably at least about 95% homologous to the sequence DWTRP (SEQ ID NO: 1114) in T10888_PEA_1_P2 (SEQ ID NO: 57).

According to preferred embodiments of the present invention, there is provided an isolated chimeric polypeptide encoding for T10888_PEA_1_P4 (SEQ ID NO: 58), comprising a first amino acid sequence being at least 90% homologous to MGPPSAPPCRLHVPWKEVLLTASLLTF-WNPPTTAKLTIESTPFNVAEGKEVLLLAHNLP QNRI-GYSWYKGERVDGNSLIVGYVIGTQQAT-PGPAYSGRETIYPNASLLIQNVTQNDTG FYTLQVIKSDLVNEEATGQFHVYPELP-KPSISSNNSNPVEDKDAVAFTCEPEVQNTTYL WWVNGQSLPVSPRLQLSNGNMTLTLLS-VKRNDAGSYECEIQNPASANRSDPVTLNVL corresponding to amino acids 1-234 of CEA6_HUMAN, which also corresponds to amino acids 1-234 of T10888_PEA_1_P4 (SEQ ID NO: 58), and a second amino acid sequence being at least 70%, optionally at least 80%, preferably at least 85%, more preferably at least 90% and most preferably at least 95% homologous to a polypeptide having the sequence LLLSSQLWPPSASRLECWPGWL (SEQ ID NO: 1115) corresponding to amino acids 235-256 of T10888_PEA_1_P4 (SEQ ID NO: 58), wherein said first and second amino acid sequences are contiguous and in a sequential order.

According to preferred embodiments of the present invention, there is provided an isolated polypeptide encoding for a tail of T10888_PEA_1_P4 (SEQ ID NO: 58), comprising a polypeptide being at least 70%, optionally at least about 80%, preferably at least about 85%, more preferably at least about 90% and most preferably at least about 95% homologous to the sequence LLLSSQLWPPSASRLECWPGWL (SEQ ID NO: 1115) in T10888_PEA_1_P4 (SEQ ID NO: 58).

According to preferred embodiments of the present invention, there is provided an isolated chimeric polypeptide encoding for T10888_PEA_1_P4 (SEQ ID NO: 58), comprising a first amino acid sequence being at least 90% homologous to MGPPSAPPCRLHVPWKEVLLTASLLTF-WNPPTTAKLTIESTPFNVAEGKEVLLLAHNLP QNRI-GYSWYKGERVDGNSLIVGYVIGTQQAT-PGPAYSGRETIYPNASLLIQNVTQNDTG FYTLQVIKSDLVNEEATGQFHVYPELP-KPSISSNNSNPVEDKDAVAFTCEPEVQNTTYL WWVNGQSLPVSPRLQLSNGNMTLTLLS-VKRNDAGSYECEIQNPASANRSDPVTLNVL corresponding to amino acids 1-234 of Q13774 (SEQ ID NO: 959), which also corresponds to amino acids 1-234 of T10888_PEA_1_P4 (SEQ ID NO: 58), and a second amino acid sequence being at least 70%, optionally at least 80%, preferably at least 85%, more preferably at least 90% and most preferably at least 95% homologous to a polypeptide having the sequence LLLSSQLWPPSASRLECWPGWL (SEQ ID NO: 1115) corresponding to amino acids 235-256 of T10888_PEA_1_P4 (SEQ ID NO: 58), wherein said first and second amino acid sequences are contiguous and in a sequential order.

According to preferred embodiments of the present invention, there is provided an isolated polypeptide encoding for a tail of T10888_PEA_1_P4 (SEQ ID NO: 58), comprising a polypeptide being at least 70%, optionally at least about 80%, preferably at least about 85%, more preferably at least about 90% and most preferably at least about 95% homologous to the sequence LLLSSQLWPPSASRLECWPGWL (SEQ ID NO: 1115) in T10888_PEA_1_P4 (SEQ ID NO: 58).

According to preferred embodiments of the present invention, there is provided an isolated chimeric polypeptide encoding for T10888_PEA_1_P5 (SEQ ID NO: 59), comprising a first amino acid sequence being at least 90% homologous to MGPPSAPPCRLHVPWKEVLLTASLLTF-WNPPTTAKLTIESTPFNVAEGKEVLLLAHNLP QNRI-GYSWYKGERVDGNSLIVGYVIGTQQAT-PGPAYSGRETIYPNASLLIQNVTQNDTG FYTLQVIKSDLVNEEATGQFHVYPELP-KPSISSNNSNPVEDKDAVAFTCEPEVQNTTYL WWVNGQSLPVSPRLQLSNGNMTLTLLS-VKRNDAGSYECEIQNPASANRSDPVTLNVLY GPDVP-TISPSKANYRPGENLNLSCHAASNP-PAQYSWFINGTFQQSTQELFIPNITVNNSGS YMCQAHNSATGLNRTTVTMITVSG corresponding to amino acids 1-320 of CEA6_HUMAN, which also corresponds to amino acids 1-320 of T10888_PEA_1_P5 (SEQ ID NO: 59), and a second amino acid sequence being at least 70%, optionally at least 80%, preferably at least 85%, more preferably at least 90% and most preferably at least 95% homologous to a polypeptide having the sequence KWI-HEALASHFQVESGSQRRARKKFSF-PTCVQGAHANPKFSPEPSQFTSADSFPLVFLFF VVFC-FLISHV (SEQ ID NO: 1116) corresponding to amino acids 321-390 of T10888_PEA_1_P5 (SEQ ID NO: 59), wherein said first and second amino acid sequences are contiguous and in a sequential order.

According to preferred embodiments of the present invention, there is provided an isolated polypeptide encoding for a tail of T10888_PEA_1_P5 (SEQ ID NO: 59), comprising a polypeptide being at least 70%, optionally at least about 80%, preferably at least about 85%, more preferably at least about 90% and most preferably at least about 95% homologous to the sequence KWIHEALASHFQVESGSQRRARKKFSF-PTCVQGAHANPKFSPEPSQFTSADSFPLVFLFF VVFC-FLISHV (SEQ ID NO: 1116) in T10888_PEA_1_P5 (SEQ ID NO: 59).

According to preferred embodiments of the present invention, there is provided an isolated chimeric polypeptide encoding for T10888_PEA_1_P6 (SEQ ID NO: 60), comprising a first amino acid sequence being at least 90% homologous to MGPPSAPPCRLHVPWKEVLLTASLLTF-WNPPTTAKLTIESTPFNVAEGKEVLLLAHNLP QNRI-GYSWYKGERVDGNSLIVGYVIGTQQAT-PGPAYSGRETIYPNASLLIQNVTQNDTG FYTLQVIKSDLVNEEATGQFHVY corresponding to amino acids 1-141 of CEA6_HUMAN, which also corresponds to amino acids 1-141 of T10888_PEA_1_P6 (SEQ ID NO: 60), and a second amino acid sequence being at least 70%, optionally at least 80%, preferably at least 85%, more preferably at least 90% and most preferably at least 95% homologous to a polypeptide having the sequence REYFH-MTSGCWGSVLLPTYGIVRPGLCLWPSLHYILYQGLDI (SEQ ID NO: 1117) corresponding to amino acids 142-183 of T10888_PEA_1_P6 (SEQ ID NO: 60), wherein said first and second amino acid sequences are contiguous and in a sequential order.

According to preferred embodiments of the present invention, there is provided an isolated polypeptide encoding for a tail of T10888_PEA__1_P6 (SEQ ID NO: 60), comprising a polypeptide being at least 70%, optionally at least about 80%, preferably at least about 85%, more preferably at least about 90% and most preferably at least about 95% homologous to the sequence REYFHMTSGCWGSVLLPTYGIVR-PGLCLWPSLHYILYQGLDI (SEQ ID NO: 1117) in T10888_PEA__1_P6 (SEQ ID NO: 60).

According to preferred embodiments of the present invention, there is provided an isolated chimeric polypeptide encoding for HSECADH_P9 (SEQ ID NO: 96), comprising a first amino acid sequence being at least 90% homologous to MGPWSRSLSALLLLLQVSSWLCQEPEP-CHPGFDAESYTFTVPRRHLERGRVLGRVNFED CTGRQRTAYFSLDTR-FKVGTDGVITVKRPLRFHNPQIH-FLVYAWDSTYRKFSTKVTLNT VGHHHRPPPHQAS-VSGIQAELLTFPNSSPGLRRQKRDWVIPPISCPENEKG PFPKNLVQI KSNKDKEGKVFYSITGQGADTP-PVGVFIIERETGWLKVTEPLDRERIATYTLFSHAVSSN GNAVEDPMEILITVTDQNDNKPEFTQEVFKGSVMEG corresponding to amino acids 1-274 of Q9UII7 (SEQ ID NO: 963), which also corresponds to amino acids 1-274 of HSEC-ADH_P9 (SEQ ID NO: 96), and a second amino acid sequence being at least 70%, optionally at least 80%, preferably at least 85%, more preferably at least 90% and most preferably at least 95% homologous to a polypeptide having the sequence TACRSRIANSCHSGDSWRNSCFANSD-SAALAVSSEESGGQRALTAPRG (SEQ ID NO: 1118) corresponding to amino acids 275-322 of HSECADH_P9 (SEQ ID NO: 96), wherein said first and second amino acid sequences are contiguous and in a sequential order.

According to preferred embodiments of the present invention, there is provided an isolated polypeptide encoding for a tail of HSECADH_P9 (SEQ ID NO: 96), comprising a polypeptide being at least 70%, optionally at least about 80%, preferably at least about 85%, more preferably at least about 90% and most preferably at least about 95% homologous to the sequence TACRSRIANSCHSGDSWRNSCFANSD-SAALAVSSEESGGQRALTAPRG (SEQ ID NO: 1118) in HSECADH_P9 (SEQ ID NO: 96).

According to preferred embodiments of the present invention, there is provided an isolated chimeric polypeptide encoding for HSECADH_P9 (SEQ ID NO: 96), comprising a first amino acid sequence being at least 90% homologous to MGPWSRSLSALLLLLQVSSWLCQEPEP-CHPGFDAESYTFTVPRRHLERGRVLGRVNFED CTGRQRTAYFSLDTR-FKVGTDGVITVKRPLRFHNPQIH-FLVYAWDSTYRKFSTKVTLNT VGHHHRPPPHQAS-VSGIQAELLTFPNSSPGLRRQKRDWVIPPISCPENEKG PFPKNLVQI KSNKDKEGKVFYSITGQGADTP-PVGVFIIERETGWLKVTEPLDRERIATYTLFSHAVSSN GNAVEDPMEILITVTDQNDNKPEFTQEVFKGSVMEG corresponding to amino acids 1-274 of Q9UII8 (SEQ ID NO: 964), which also corresponds to amino acids 1-274 of HSEC-ADH_P9 (SEQ ID NO: 96), and a second amino acid sequence being at least 70%, optionally at least 80%, preferably at least 85%, more preferably at least 90% and most preferably at least 95% homologous to a polypeptide having the sequence TACRSRIANSCHSGDSWRNSCFANSD-SAALAVSSEESGGQRALTAPRG (SEQ ID NO: 1118) corresponding to amino acids 275-322 of HSECADH_P9 (SEQ ID NO: 96), wherein said first and second amino acid sequences are contiguous and in a sequential order.

According to preferred embodiments of the present invention, there is provided an isolated polypeptide encoding for a tail of HSECADH_P9 (SEQ ID NO: 96), comprising a polypeptide being at least 70%, optionally at least about 80%, preferably at least about 85%, more preferably at least about 90% and most preferably at least about 95% homologous to the sequence TACRSRIANSCHSGDSWRNSCFANSD-SAALAVSSEESGGQRALTAPRG (SEQ ID NO: 1118) in HSECADH_P9 (SEQ ID NO: 96).

According to preferred embodiments of the present invention, there is provided an isolated chimeric polypeptide encoding for HSECADH_P9 (SEQ ID NO: 96), comprising a first amino acid sequence being at least 90% homologous to MGPWSRSLSALLLLLQVSSWLCQEPEP-CHPGFDAESYTFTVPRRHLERGRVLGRVNFED CTGRQRTAYFSLDTR-FKVGTDGVITVKRPLRFHNPQIH-FLVYAWDSTYRKFSTKVTLNT VGHHHRPPPHQAS-VSGIQAELLTFPNSSPGLRRQKRDWVIPPISCPENEKG PFPKNLVQI KSNKDKEGKVFYSITGQGADTP-PVGVFIIERETGWLKVTEPLDRERIATYTLFSHAVSSN GNAVEDPMEILITVTDQNDNKPEFTQEVFKGSVMEG corresponding to amino acids 1-274 of CAD1_HUMAN, which also corresponds to amino acids 1-274 of HSEC-ADH_P9 (SEQ ID NO: 96), and a second amino acid sequence being at least 70%, optionally at least 80%, preferably at least 85%, more preferably at least 90% and most preferably at least 95% homologous to a polypeptide having the sequence TACRSRIANSCHSGDSWRNSCFANSD-SAALAVSSEESGGQRALTAPRG (SEQ ID NO: 1118) corresponding to amino acids 275-322 of HSECADH_P9 (SEQ ID NO: 96), wherein said first and second amino acid sequences are contiguous and in a sequential order.

According to preferred embodiments of the present invention, there is provided an isolated polypeptide encoding for a tail of HSECADH_P9 (SEQ ID NO: 96), comprising a polypeptide being at least 70%, optionally at least about 80%, preferably at least about 85%, more preferably at least about 90% and most preferably at least about 95% homologous to the sequence TACRSRIANSCHSGDSWRNSCFANSD-SAALAVSSEESGGQRALTAPRG (SEQ ID NO: 1118) in HSECADH_P9 (SEQ ID NO: 96).

According to preferred embodiments of the present invention, there is provided an isolated chimeric polypeptide encoding for HSECADH_P13 (SEQ ID NO: 97), comprising a first amino acid sequence being at least 90% homologous to MGPWSRSLSALLLLLQVSSWLCQEPEP-CHPGFDAESYTFTVPRRHLERGRVLGRVNFED CTGRQRTAYFSLDTR-FKVGTDGVITVKRPLRFHNPQIH-FLVYAWDSTYRKFSTKVTLNT VGHHHRPPPHQAS-VSGIQAELLTFPNSSPGLRRQKRDWVIPPISCPENEKG PFPKNLVQI KSNKDKEGKVFYSITGQGADTP-PVGVFIIERETGWLKVTEPLDRERIATYTLFSHAVSSN GNAVEDPMEILITVTDQNDNK-PEFTQEVFKGSVMEGALPGTSVMEVTATDADDDVNT YNAAIAYTILSQDPELPDKNMFTINRN-TGVISVVTTGLDRESFPTYTLVVQAADLQGEGL STTATAVITVTDTNDNPPIFNPTT corresponding to amino acids 1-379 of Q9UII7 (SEQ ID NO: 963), which also corresponds to amino acids 1-379 of HSECADH_P13 (SEQ ID NO: 97), and a second amino acid sequence VIL corresponding to amino acids 380-382 of HSECADH_P13 (SEQ ID NO: 97), wherein said first and second amino acid sequences are contiguous and in a sequential order.

According to preferred embodiments of the present invention, there is provided an isolated chimeric polypeptide encoding for HSECADH_P13 (SEQ ID NO: 97), comprising a first amino acid sequence being at least 90% homologous to MGPWSRSLSALLLLLQVSSWLCQEPEP- CHPGFDAESYTFTVPRRHLERGRVLGRVNFEDCTGRQRTAYFSLDTR-FKVGTDGVITVKRPLRFHNPQIH-FLVYAWDSTYRKFSTKVTLNT VGHHHRPPPHQAS-VSGIQAELLTFPNSSPGLRRQKRDWVIPPISCPENEKG PFPKNLVQI KSNKDKEGKVFYSITGQGADTP-PVGVFIIERETGWLKVTEPLDRERIATYTLFSHAVSSNGNAVEDPMEILITVTDQNDNK-PEFTQEVFKGSVMEGALPGTSVMEVTATDADDDVNTYNAAIAYTILSQDPELPDKNMFTINRN-TGVISVVTTGLDRESFPTYTLVVQAADLQGEGLSTTATAVITVTDTNDNPPIFNPTT corresponding to amino acids 1-379 of Q9UII8 (SEQ ID NO: 964), which also corresponds to amino acids 1-379 of HSECADH_P13 (SEQ ID NO: 97), and a second amino acid sequence VIL corresponding to amino acids 380-382 of HSECADH_P13 (SEQ ID NO: 97), wherein said first and second amino acid sequences are contiguous and in a sequential order.

According to preferred embodiments of the present invention, there is provided an isolated chimeric polypeptide encoding for HSECADH_P13 (SEQ ID NO: 97), comprising a first amino acid sequence being at least 90% homologous to MGPWSRSLSALLLLLQVSSWLCQEPEP-CHPGFDAESYTFTVPRRHLERGRVLGRVNFEDCTGRQRTAYFSLDTR-FKVGTDGVITVKRPLRFHNPQIH-FLVYAWDSTYRKFSTKVTLNT VGHHHRPPPHQAS-VSGIQAELLTFPNSSPGLRRQKRDWVIPPISCPENEKG PFPKNLVQI KSNKDKEGKVFYSITGQGADTP-PVGVFIIERETGWLKVTEPLDRERIATYTLFSHAVSSNGNAVEDPMEILITVTDQNDNK-PEFTQEVFKGSVMEGALPGTSVMEVTATDADDDVNTYNAAIAYTILSQDPELPDKNMFTINRN-TGVISVVTTGLDRESFPTYTLVVQAADLQGEGLSTTATAVITVTDTNDNPPIFNPTT corresponding to amino acids 1-379 of CAD1_HUMAN, which also corresponds to amino acids 1-379 of HSECADH_P13 (SEQ ID NO: 97), and a second amino acid sequence VIL corresponding to amino acids 380-382 of HSECADH_P13 (SEQ ID NO: 971, wherein said first and second amino acid sequences are contiguous and in a sequential order.

According to preferred embodiments of the present invention, there is provided an isolated chimeric polypeptide encoding for HSECADH_P14 (SEQ ID NO: 98), comprising a first amino acid sequence being at least 90% homologous to MGPWSRSLSALLLLLQVSSWLCQEPEP-CHPGFDAESYTFTVPRRHLERGRVLGRVNFEDCTGRQRTAYFSLDTR-FKVGTDGVITVKRPLRFHNPQIH-FLVYAWDSTYRKFSTKVTLNT VGHHHRPPPHQAS-VSGIQAELLTFPNSSPGLRRQKRDWVIPPISCPENEKG PFPKNLVQI KSNKDKEGKVFYSITGQGADTP-PVGVFIIERETGWLKVTEPLDRERIATYTLFSHAVSSNGNAVEDPMEILITVTDQNDNK-PEFTQEVFKGSVMEGALPGTSVMEVTATDADDDVNTYNAAIAYTILSQDPELPDKNMFTINRN-TGVISVVTTGLDRE corresponding to amino acids 1-336 of Q9UII7 (SEQ ID NO: 963), which also corresponds to amino acids 1-336 of HSECADH_P14 (SEQ ID NO: 98), and a second amino acid sequence being at least 70%, optionally at least 80%, preferably at least 85%, more preferably at least 90% and most preferably at least 95% homologous to a polypeptide having the sequence VRGQEDPEGVEDKCV-LAQSRGQSKILLGQLSVNTVMV (SEQ ID NO: 1119) corresponding to amino acids 337-373 of HSECADH_P14 (SEQ ID NO: 98), wherein said first and second amino acid sequences are contiguous and in a sequential order.

According to preferred embodiments of the present invention, there is provided an isolated polypeptide encoding for a tail of HSECADH_P14 (SEQ ID NO: 98), comprising a polypeptide being at least 70%, optionally at least about 80%, preferably at least about 85%, more preferably at least about 90% and most preferably at least about 95% homologous to the sequence VRGQEDPEGVEDKCVLAQS-RGQSKILLGQLSVNTVMV (SEQ ID NO: 1119) in HSECADH_P14 (SEQ ID NO: 98).

According to preferred embodiments of the present invention, there is provided an isolated chimeric polypeptide encoding for HSECADH_P14 (SEQ ID NO: 98), comprising a first amino acid sequence being at least 90% homologous to MGPWSRSLSALLLLLQVSSWLCQEPEP-CHPGFDAESYTFTVPRRHLERGRVLGRVNFEDCTGRQRTAYFSLDTR-FKVGTDGVITVKRPLRFHNPQIH-FLVYAWDSTYRKFSTKVTLNT VGHHHRPPPHQAS-VSGIQAELLTFPNSSPGLRRQKRDWVIPPISCPENEKG PFPKNLVQI KSNKDKEGKVFYSITGQGADTP-PVGVFIIERETGWLKVTEPLDRERIATYTLFSHAVSSNGNAVEDPMEILITVTDQNDNK-PEFTQEVFKGSVMEGALPGTSVMEVTATDADDDVNTYNAAIAYTILSQDPELPDKNMFTINRN-TGVISVVTTGLDRE corresponding to amino acids 1-336 of Q9UII8 (SEQ ID NO: 964), which also corresponds to amino acids 1-336 of HSECADH_P14 (SEQ ID NO: 98), and a second amino acid sequence being at least 70%, optionally at least 80%, preferably at least 85%, more preferably at least 90% and most preferably at least 95% homologous to a polypeptide having the sequence VRGQEDPEGVEDKCV-LAQSRGQSKILLGQLSVNTVMV (SEQ ID NO: 1119) corresponding to amino acids 337-373 of HSECADH_P14 (SEQ ID NO: 98), wherein said first and second amino acid sequences are contiguous and in a sequential order.

According to preferred embodiments of the present invention, there is provided an isolated polypeptide encoding for a tail of HSECADH_P14 (SEQ ID NO: 98), comprising a polypeptide being at least 70%, optionally at least about 80%, preferably at least about 85%, more preferably at least about 90% and most preferably at least about 95% homologous to the sequence VRGQEDPEGVEDKCVLAQS-RGQSKILLGQLSVNTVMV (SEQ ID NO: 1119) in HSECADH_P14 (SEQ ID NO: 98).

According to preferred embodiments of the present invention, there is provided an isolated chimeric polypeptide encoding for HSECADH_P14 (SEQ ID NO: 98), comprising a first amino acid sequence being at least 90% homologous to MGPWSRSLSALLLLLQVSSWLCQEPEP-CHPGFDAESYTFTVPRRHLERGRVLGRVNFEDCTGRQRTAYFSLDTR-FKVGTDGVITVKRPLRFHNPQIH-FLVYAWDSTYRKFSTKVTLNT VGHHHRPPPHQAS-VSGIQAELLTFPNSSPGLRRQKRDWVIPPISCPENEKG PFPKNLVQI KSNKDKEGKVFYSITGQGADTP-PVGVFIIERETGWLKVTEPLDRERIATYTLFSHAVSSNGNAVEDPMEILITVTDQNDNK-PEFTQEVFKGSVMEGALPGTSVMEVTATDADDDVNTYNAAIAYTILSQDPELPDKNMFTINRN-TGVISVVTTGLDRE corresponding to amino acids 1-336 of CAD1_HUMAN, which also corresponds to amino acids 1-336 of HSECADH_P14 (SEQ ID NO: 98), and a second amino acid sequence being at least 70%, optionally at least 80%, preferably at least 85%, more preferably at least 90% and most preferably at least 95% homologous to a polypeptide having the sequence VRGQEDPEGVEDKCVLAQS-RGQSKILLGQLSVNTVMV (SEQ ID NO: 1119) corresponding to amino acids 337-373 of HSECADH_P14 (SEQ ID NO: 98), wherein said first and second amino acid sequences are contiguous and in a sequential order.

According to preferred embodiments of the present invention, there is provided an isolated polypeptide encoding for a tail of HSECADH_P14 (SEQ ID NO: 98), comprising a polypeptide being at least 70%, optionally at least about 80%, preferably at least about 85%, more preferably at least about 90% and most preferably at least about 95% homologous to the sequence VRGQEDPEGVEDKCVLAQS-RGQSKILLGQLSVNTVMV (SEQ ID NO: 1119) in HSEC-ADH_P14 (SEQ ID NO: 98).

According to preferred embodiments of the present invention, there is provided an isolated chimeric polypeptide encoding for HSECADH_P15 (SEQ ID NO: 99), comprising a first amino acid sequence being at least 90% homologous to MGPWSRSLSALLLLLQVSSWLCQEPEP-CHPGFDAESYTFTVPRRHLERGRVLGRVNFED CTGRQRTAYFSLDTR-FKVGTDGVITVKRPLRFHNPQIH-FLVYAWDSTYRKFSTKVTLNT VGHHHRPPPHQAS-VSGIQAELLTFPNSSPGLRRQKRDWVIPPISCPENEKG PFPKNLVQI KSNKDKEGKVFYSITGQGADTP-PVGVFIIERETGWLKVTEPLDRERIATYT corresponding to amino acids 1-229 of Q9UII7 (SEQ ID NO: 963), which also corresponds to amino acids 1-229 of HSECADH_P15 (SEQ ID NO: 99), and a second amino acid sequence VSIS corresponding to amino acids 230-233 of HSECADH_P15 (SEQ ID NO: 99), wherein said first and second amino acid sequences are contiguous and in a sequential order.

According to preferred embodiments of the present invention, there is provided an isolated chimeric polypeptide encoding for HSECADH_P15 (SEQ ID NO: 99), comprising a first amino acid sequence being at least 90% homologous to MGPWSRSLSALLLLLQVSSWLCQEPEP-CHPGFDAESYTFTVPRRHLERGRVLGRVNFED CTGRQRTAYFSLDTR-FKVGTDGVITVKRPLRFHNPQIH-FLVYAWDSTYRKFSTKVTLNT VGHHHRPPPHQAS-VSGIQAELLTFPNSSPGLRRQKRDWVIPPISCPENEKG PFPKNLVQI KSNKDKEGKVFYSITGQGADTP-PVGVFIIERETGWLKVTEPLDRERIATYT corresponding to amino acids 1-229 of Q9UII8 (SEQ ID NO: 964), which also corresponds to amino acids 1-229 of HSECADH_P15 (SEQ ID NO: 99), and a second amino acid sequence VSIS corresponding to amino acids 230-233 of HSECADH_P15 (SEQ ID NO: 99), wherein said first and second amino acid sequences are contiguous and in a sequential order.

According to preferred embodiments of the present invention, there is provided an isolated chimeric polypeptide encoding for HSECADH_P15 (SEQ ID NO: 99), comprising a first amino acid sequence being at least 90% homologous to MGPWSRSLSALLLLLQVSSWLCQEPEP-CHPGFDAESYTFTVPRRHLERGRVLGRVNFED CTGRQRTAYFSLDTR-FKVGTDGVITVKRPLRFHNPQIH-FLVYAWDSTYRKFSTKVTLNT VGHHHRPPPHQAS-VSGIQAELLTFPNSSPGLRRQKRDWVIPPISCPENEKG PFPKNLVQI KSNKDKEGKVFYSITGQGADTP-PVGVFIIERETGWLKVTEPLDRERIATYT corresponding to amino acids 1-229 of CAD1_HUMAN, which also corresponds to amino acids 1-229 of HSECADH_P15 (SEQ ID NO: 99), and a second amino acid sequence VSIS corresponding to amino acids 230-233 of HSECADH_P15 (SEQ ID NO: 99), wherein said first and second amino acid sequences are contiguous and in a sequential order.

According to preferred embodiments of the present invention, there is provided an isolated chimeric polypeptide encoding for T59832_P5 (SEQ ID NO: 778), comprising a first amino acid sequence being at least 90% homologous to MTLSPLLLFLPPLLLLLDVPTAAVQAS-PLQALDFFGNGPPVNYK corresponding to amino acids 12-55 of GILT_HUMAN, which also corresponds to amino acids 1-44 of T59832_P5 (SEQ ID NO: 778), and a second amino acid sequence being at least 70%, optionally at least 80%, preferably at least 85%, more preferably at least 90% and most preferably at least 95% homologous to a polypeptide having the sequence VGTATGRAGWREQAPCRGTR-LLLSPQTSQGKTRAPRGRCPCRVPGK-TLFSSRRCGHTP SVPFRFRIPHLRGAAASTRLVPPKGSM-SAYCVLLGQELGSPFVAQGTSSAAGQGPPACIL AATLDAFIPARAGLACLWDLLGRCPRG (SEQ ID NO: 1120) corresponding to amino acids 45-189 of T59832_P5 (SEQ ID NO: 778), wherein said first and second amino acid sequences are contiguous and in a sequential order.

According to preferred embodiments of the present invention, there is provided an isolated polypeptide encoding for a tail of T59832_P5 (SEQ ID NO: 778), comprising a polypeptide being at least 70%, optionally at least about 80%, preferably at least about 85%, more preferably at least about 90% and most preferably at least about 95% homologous to the sequence VGTATGRAGWREQAPCRGTRLLL-SPQTSQGKTRAPRGRCPCRVPGKTLFSSRRCGHTP SVPFRFRIPHLRGAAASTRLVPPKGSM-SAYCVLLGQELGSPFVAQGTSSAAGQGPPACIL AATLDAFIPARAGLACLWDLLGRCPRG (SEQ ID NO: 1120) in T59832_P5 (SEQ ID NO: 778).

According to preferred embodiments of the present invention, there is provided an isolated chimeric polypeptide encoding for T59832_P7 (SEQ ID NO: 779), comprising a first amino acid sequence being at least 90% homologous to MTLSPLLLFLPPLLLLLDVPTAAVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVEACVLDELD-MELAFLTIVCMEEFEDMERSLPLCLQ-LYAPGLSPDTIM ECAMGDRGMQLMHANAQRT-DALQPPHEYVPWVTVNG corresponding to amino acids 12-223 of GILT_HUMAN, which also corresponds to amino acids 1-212 of T59832_P7 (SEQ ID NO: 779), and a second amino acid sequence being at least 70%, optionally at least 80%, preferably at least 85%, more preferably at least 90% and most preferably at least 95% homologous to a polypeptide having the sequence VRIFLALSLTLIVPWSQG-WTRQRDQR (SEQ ID NO: 1089) corresponding to amino acids 213-238 of T59832_P7 (SEQ ID NO: 779), wherein said first and second amino acid sequences are contiguous and in a sequential order.

According to preferred embodiments of the present invention, there is provided an isolated polypeptide encoding for a tail of T59832_P7 (SEQ ID NO: 779), comprising a polypeptide being at least 70%, optionally at least about 80%, preferably at least about 85%, more preferably at least about 90% and most preferably at least about 95% homologous to the sequence VRIFLALSLTLIVPWSQGWTRQRDQR (SEQ ID NO: 1089) in T59832_P7 (SEQ ID NO: 779).

According to preferred embodiments of the present invention, there is provided an isolated chimeric polypeptide encoding for T59832_P7 (SEQ ID NO: 779), comprising a first amino acid sequence being at least 90% homologous to MTLSPLLLFLPPLLLLLDVPTAAVQAS- PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVEACVLDELD-MELAFLTIVCMEEFEDMERSLPLCLQ-LYAPGLSPDTIM ECAMGDRGMQLMHANAQRT-DALQPPHEYVPWVTVNG corresponding to amino acids 1-212 of BAC98466, which also corresponds to amino acids 1-212 of T59832_P7 (SEQ ID NO: 779), and a second amino acid sequence being at least 70%, optionally at least 80%, preferably at least 85%, more preferably at least 90% and most preferably at least 95% homologous to a polypeptide having the sequence VRIFLALSLTLIVPWSQG-WTRQRDQR (SEQ ID NO: 1089) corresponding to amino acids 213-238 of T59832_P7 (SEQ ID NO: 779), wherein said first and second amino acid sequences are contiguous and in a sequential order.

According to preferred embodiments of the present invention, there is provided an isolated polypeptide encoding for a tail of T59832_P7 (SEQ ID NO: 779), comprising a polypeptide being at least 70%, optionally at least about 80%, preferably at least about 85%, more preferably at least about 90% and most preferably at least about 95% homologous to the sequence VRIFLALSLTLIVPWSQGWTRQRDQR (SEQ ID NO: 1089) in T59832_P7 (SEQ ID NO: 779).

According to preferred embodiments of the present invention, there is provided an isolated chimeric polypeptide encoding for T59832_P7 (SEQ ID NO: 779), comprising a first amino acid sequence being at least 70%, optionally at least 80%, preferably at least 85%, more preferably at least 90% and most preferably at least 95% homologous to a polypeptide having the sequence MTLSPLLLFLPPLLLLL-DVPTAAVQASPLQALDFFGNGPPVNYKT-GNLYLRGPLKKSNA PLVNVTLYYEALCGGCRAF-LIRELFPTWLLV (SEQ ID NO: 1121) corresponding to amino acids 1-90 of T59832_P7 (SEQ ID NO: 779), and a second amino acid sequence being at least 90% homologous to MEILNVTLVPYGNAQEQNVSGRWEFKC-QHGEEECKFNKVEACVLDELDMELAFLTIVC MEEFEDMERSLPLCLQLYAPGLSPD-TIMECAMGDRGMQLMHANAQRTDALQPPHEYV PWVTVNGVRIFLALSLTLIVPWSQGWTRQRDQR (SEQ ID NO: 1089) corresponding to amino acids 1-148 of BAC85622, which also corresponds to amino acids 91-238 of T59832_P7 (SEQ ID NO: 779), wherein said first and second amino acid sequences are contiguous and in a sequential order.

According to preferred embodiments of the present invention, there is provided an isolated polypeptide encoding for a head of T59832_P7 (SEQ ID NO: 779), comprising a polypeptide being at least 70%, optionally at least about 80%, preferably at least about 85%, more preferably at least about 90% and most preferably at least about 95% homologous to the sequence MTLSPLLLFLPPLLLLLDVPTAAVQAS-PLQALDFFGNGPPVNYKTGNLYLRGPLKKSNA PLVNVTLYYEALCGGCRAFLIRELFPTWLLV (SEQ ID NO: 1121) of T59832_P7 (SEQ ID NO: 779).

According to preferred embodiments of the present invention, there is provided an isolated chimeric polypeptide encoding for T59832_P7 (SEQ ID NO: 779), comprising a first amino acid sequence being at least 90% homologous to MTLSPLLLFLPPLLLLLDVPTAAVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVEACVLDELD-MELAFLTIVCMEEFEDMERSLPLCLQ-LYAPGLSPDTIM ECAMGDRGMQLMHANAQRT-DALQPPHEYVPWVTVNG corresponding to amino acids 1-212 of Q8WU77, which also corresponds to amino acids 1-212 of T59832_P7 (SEQ ID NO: 779), and a second amino acid sequence being at least 70%, optionally at least 80%, preferably at least 85%, more preferably at least 90% and most preferably at least 95% homologous to a polypeptide having the sequence VRIFLALSLTLIVPWSQG-WTRQRDQR (SEQ ID NO: 1089) corresponding to amino acids 213-238 of T59832_P7 (SEQ ID NO: 779), wherein said first and second amino acid sequences are contiguous and in a sequential order.

According to preferred embodiments of the present invention, there is provided an isolated polypeptide encoding for a tail of T59832_P7 (SEQ ID NO: 779), comprising a polypeptide being at least 70%, optionally at least about 80%, preferably at least about 85%, more preferably at least about 90% and most preferably at least about 95% homologous to the sequence VRIFLALSLTLIVPWSQGWTRQRDQR (SEQ ID NO: 1089) in T59832_P7 (SEQ ID NO: 779).

According to preferred embodiments of the present invention, there is provided an isolated chimeric polypeptide encoding for T59832_P9 (SEQ ID NO: 780), comprising a first amino acid sequence being at least 90% homologous to MTLSPLLLFLPPLLLLLDVPTAAVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVEACVLDELD-MELAFLTIVCMEEFEDMERSLPLCLQ-LYAPGLSPDTIM ECAMGDRGMQLMHANAQRT-DALQPPHE corresponding to amino acids 12-214 of GILT_HUMAN, which also corresponds to amino acids 1-203 of T59832_P9 (SEQ ID NO: 780), and a second amino acid sequence being at least 70%, optionally at least 80%, preferably at least 85%, more preferably at least 90% and most preferably at least 95% homologous to a polypeptide having the sequence NPWKIRPSSLPLSASCTRARSRM-SALPQPAPSGVFASSDGR (SEQ ID NO: 1090) corresponding to amino acids 204-244 of T59832_P9 (SEQ ID NO: 780), wherein said first and second amino acid sequences are contiguous and in a sequential order.

According to preferred embodiments of the present invention, there is provided an isolated polypeptide encoding for a tail of T59832_P9 (SEQ ID NO: 780), comprising a polypeptide being at least 70%, optionally at least about 80%, preferably at least about 85%, more preferably at least about 90% and most preferably at least about 95% homologous to the sequence NPWKIRPSSLPLSASCTRARSRMSALPQ-PAPSGVFASSDGR (SEQ ID NO: 1090) in T59832_P9 (SEQ ID NO: 780).

According to preferred embodiments of the present invention, there is provided an isolated chimeric polypeptide encoding for T59832_P9 (SEQ ID NO: 780), comprising a first amino acid sequence being at least 90% homologous to MTLSPLLLFLPPLLLLLDVPTAAVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVEACVLDELD-MELAFLTIVCMEEFEDMERSLPLCLQ-LYAPGLSPDTIM ECAMGDRGMQLMHANAQRT-DALQPPHE corresponding to amino acids 1-203 of BAC98466, which also corresponds to amino acids 1-203 of T59832_P9 (SEQ ID NO: 780), and a second amino acid sequence being at least 70%, optionally at least 80%, preferably at least 85%, more preferably at least 90% and most preferably at least 95% homologous to a polypeptide having the sequence NPWKIRPSSLPLSASCTRARSRMSALPQ-PAPSGVFASSDGR (SEQ ID NO: 1090) corresponding to amino acids 204-244 of T59832_P9 (SEQ ID NO: 780), wherein said first and second amino acid sequences are contiguous and in a sequential order.

According to preferred embodiments of the present invention, there is provided an isolated polypeptide encoding for a tail of T59832_P9 (SEQ ID NO: 780), comprising a polypeptide being at least 70%, optionally at least about 80%, preferably at least about 85%, more preferably at least about 90% and most preferably at least about 95% homologous to the sequence NPWKIRPSSLPLSASCTRARSRMSALPQ-PAPSGVFASSDGR (SEQ ID NO: 1090) in T59832_P9 (SEQ ID NO: 780).

According to preferred embodiments of the present invention, there is provided an isolated chimeric polypeptide encoding for T59832_P9 (SEQ ID NO: 780), comprising a first amino acid sequence being at least 70%, optionally at least 80%, preferably at least 85%, more preferably at least 90% and most preferably at least 95% homologous to a polypeptide having the sequence MTLSPLLLFLPPLLLLL-DVPTAAVQASPLQALDFFGNGPPVNYKT-GNLYLRGPLKKSNA PLVNVTLYYEALCGGCRAF-LIRELFPTWLLV (SEQ ID NO: 1121) corresponding to amino acids 1-90 of T59832_P9 (SEQ ID NO: 780), second amino acid sequence being at least 90% homologous to MEILNVTLVPYGNAQEQNVSGRWEFKC-QHGEEECKFNKVEACVLDELDMELAFLTIVC MEEFEDMERSLPLCLQLYAPGLSPD-TIMECAMGDRGMQLMHANAQRTDALQPPHE corresponding to amino acids 1-113 of BAC85622, which also corresponds to amino acids 91-203 of T59832_P9 (SEQ ID NO: 780), and a third amino acid sequence being at least 70%, optionally at least 80%, preferably at least 85%, more preferably at least 90% and most preferably at least 95% homologous to a polypeptide having the sequence NPWKIRPSS-LPLSASCTRARSRMSALPQPAPSGVFASSDGR (SEQ ID NO: 1090) corresponding to amino acids 204-244 of T59832_P9 (SEQ ID NO: 780), wherein said first, second and third amino acid sequences are contiguous and in a sequential order.

According to preferred embodiments of the present invention, there is provided an isolated polypeptide encoding for a head of T59832_P9 (SEQ ID NO: 780), comprising a polypeptide being at least 70%, optionally at least about 80%, preferably at least about 85%, more preferably at least about 90% and most preferably at least about 95% homologous to the sequence MTLSPLLLFLPPLLLLLDVPTAAVQAS-PLQALDFFGNGPPVNYKTGNLYLRGPLKKSNA PLVNVTLYYEALCGGCRAFLIRELFPTWLLV (SEQ ID NO: 1121) of T59832_P9 (SEQ ID NO: 780).

According to preferred embodiments of the present invention, there is provided an isolated polypeptide encoding for a tail of T59832_P9 (SEQ ID NO: 780), comprising a polypeptide being at least 70%, optionally at least about 80%, preferably at least about 85%, more preferably at least about 90% and most preferably at least about 95% homologous to the sequence NPWKIRPSSLPLSASCTRARSRMSALPQ-PAPSGVFASSDGR (SEQ ID NO: 1090) in T59832_P9 (SEQ ID NO: 780).

According to preferred embodiments of the present invention, there is provided an isolated chimeric polypeptide encoding for T59832_P9 (SEQ ID NO: 780), comprising a first amino acid sequence being at least 90% homologous to MTLSPLLLFLPPLLLLLDVPTAAVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVEACVLDELD-MELAFLTIVCMEEFEDMERSLPLCLQ-LYAPGLSPDTIM ECAMGDRGMQLMHANAQRT-DALQPPHE corresponding to amino acids 1-203 of Q8WU77, which also corresponds to amino acids 1-203 of T59832_P9 (SEQ ID NO: 780), and a second amino acid sequence being at least 70%, optionally at least 80%, preferably at least 85%, more preferably at least 90% and most preferably at least 95% homologous to a polypeptide having the sequence NPWKIRPSSLPLSASCTRARSRMSALPQ-PAPSGVFASSDGR (SEQ ID NO: 1090) corresponding to amino acids 204-244 of T59832_P9 (SEQ ID NO: 780), wherein said first and second amino acid sequences are contiguous and in a sequential order.

According to preferred embodiments of the present invention, there is provided an isolated polypeptide encoding for a tail of T59832_P9 (SEQ ID NO: 780), comprising a polypeptide being at least 70%, optionally at least about 80%, preferably at least about 85%, more preferably at least about 90% and most preferably at least about 95% homologous to the sequence NPWKIRPSSLPLSASCTRARSRMSALPQ-PAPSGVFASSDGR (SEQ ID NO: 1090) in T59832_P9 (SEQ ID NO: 780).

According to preferred embodiments of the present invention, there is provided an isolated chimeric polypeptide encoding for T59832_P12 (SEQ ID NO: 781), comprising a first amino acid sequence being at least 90% homologous to MTLSPLLLFLPPLLLLLDVPTAAVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVE corresponding to amino acids 12-141 of GILT_HUMAN, which also corresponds to amino acids 1-130 of T59832_P12 (SEQ ID NO: 781), and a second amino acid sequence being at least 90% homologous to CLQ-LYAPGLSPDTIMECAMGDRGMQLMHA-NAQRTDALQPPHEYVPWVTVNGKPLED QTQLLTLVCQLYQGKKPDVCPSSTSSLRSVCFK corresponding to amino acids 173-261 of GILT_HUMAN, which also corresponds to amino acids 131-219 of T59832_P12 (SEQ ID NO: 781), wherein said first and second amino acid sequences are contiguous and in a sequential order.

According to preferred embodiments of the present invention, there is provided an isolated chimeric polypeptide encoding for an edge portion of T59832_P12 (SEQ ID NO: 781), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EC, having a structure as follows: a sequence starting from any of amino acid numbers 130−x to 130; and ending at any of amino acid numbers 131+((n−2)−x), in which x varies from 0 to n−2.

According to preferred embodiments of the present invention, there is provided an isolated chimeric polypeptide encoding for T59832_P12 (SEQ ID NO: 781), comprising a first amino acid sequence being at least 70%, optionally at least 80%, preferably at least 85%, more preferably at least 90% and most preferably at least 95% homologous to a polypeptide having the sequence MTLSPLLLFLPPLLLLL-DVPTAAVQASPLQALDFFGNGPPVNYKT-GNLYLRGPLKKSNA PLVNVTLYYEALCGGCRAF-LIRELFPTWLLV (SEQ ID NO: 1121) corresponding to amino acids 1-90 of T59832_P12 (SEQ ID NO: 781), second amino acid sequence being at least 90% homologous to MEILNVTLVPYGNAQEQNVSGRWEFKC-QHGEEECKFNKVE corresponding to amino acids 1-40 of BAC85622, which also corresponds to amino acids 91-130 of T59832_P12 (SEQ ID NO: 781), third amino acid sequence being at least 90% homologous to CLQLYAPGLSPDTIME-CAMGDRGMQLMHANAQRTDALQP-PHEYVPWVTVNG corresponding to amino acids 72-122 of BAC85622, which also corresponds to amino acids 131-181 of T59832_P12 (SEQ ID NO: 781), and a fourth amino acid sequence being at least 70%, optionally at least 80%, preferably at least 85%, more preferably at least 90% and most preferably at least 95% homologous to a polypeptide having the sequence KPLEDQTQLLTLVCQLYQGKKPD-VCPSSTSSLRSVCFK (SEQ ID NO: 1124) corresponding to amino acids 182-219 of T59832_P12 (SEQ ID NO: 781), wherein said first, second, third and fourth amino acid sequences are contiguous and in a sequential order.

According to preferred embodiments of the present invention, there is provided an isolated polypeptide encoding for a head of T59832_P12 (SEQ ID NO: 781), comprising a polypeptide being at least 70%, optionally at least about 80%, preferably at least about 85%, more preferably at least about 90% and most preferably at least about 95% homologous to the sequence MTLSPLLLFLPPLLLLLDVPTAAVQAS-PLQALDFFGNGPPVNYKTGNLYLRGPLKKSNA PLVNVTLYYEALCGGCRAFLIRELFPTWLLV (SEQ ID NO: 1121) of T59832_P12 (SEQ ID NO: 781).

According to preferred embodiments of the present invention, there is provided an isolated chimeric polypeptide encoding for an edge portion of T59832_P12 (SEQ ID NO: 781), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EC, having a structure as follows: a sequence starting from any of amino acid numbers 130−x to 130; and ending at any of amino acid numbers 131+((n−2)−x), in which x varies from 0 to n−2.

According to preferred embodiments of the present invention, there is provided an isolated polypeptide encoding for a tail of T59832_P12 (SEQ ID NO: 781), comprising a polypeptide being at least 70%, optionally at least about 80%, preferably at least about 85%, more preferably at least about 90% and most preferably at least about 95% homologous to the sequence KPLEDQTQLLTLVCQLYQGKKPD-VCPSSTSSLRSVCFK (SEQ ID NO: 1124) in T59832_P12 (SEQ ID NO: 781).

According to preferred embodiments of the present invention, there is provided an isolated chimeric polypeptide encoding for T59832_P12 (SEQ ID NO: 781), comprising a first amino acid sequence being at least 90% homologous to MTLSPLLLFLPPLLLLLDVPTAAVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVE corresponding to amino acids 1-130 of Q8WU77, which also corresponds to amino acids 1-130 of T59832_P12 (SEQ ID NO: 781), and a second amino acid sequence being at least 90% homologous to CLQLYAPGL-SPDTIMECAMGDRGMQLMHANAQRT-DALQPPHEYVPWVTVNGKPLED QTQLLTLVCQ-LYQGKKPDVCPSSTSSLRSVCFK corresponding to amino acids 162-250 of Q8WU77, which also corresponds to amino acids 131-219 of T59832_P12 (SEQ ID NO: 781), wherein said first and second amino acid sequences are contiguous and in a sequential order.

According to preferred embodiments of the present invention, there is provided an isolated chimeric polypeptide encoding for an edge portion of T59832_P12 (SEQ ID NO: 781), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EC, having a structure as follows: a sequence starting from any of amino acid numbers 130−x to 130; and ending at any of amino acid numbers 131+((n−2)−x), in which x varies from 0 to n−2.

According to preferred embodiments of the present invention, there is provided an isolated chimeric polypeptide encoding for T59832_P18 (SEQ ID NO: 782), comprising a first amino acid sequence being at least 90% homologous to MTLSPLLLFLPPLLLLLDVPTAAVQAS-PLQALDFFGNGPPVNYK corresponding to amino acids 12-55 of GILT_HUMAN, which also corresponds to amino acids 1-44 of T59832_P18 (SEQ ID NO: 782), and a second amino acid sequence being at least 90% homologous to CLQ-LYAPGLSPDTIMECAMGDRGMQLMHA-NAQRTDALQPPHEYVPWVTVNGKPLED QTQLLTLVCQLYQGKKPDVCPSSTSSLRSVCFK corresponding to amino acids 173-261 of GILT_HUMAN, which also corresponds to amino acids 45-133 of T59832_P18 (SEQ ID NO: 782), wherein said first and second amino acid sequences are contiguous and in a sequential order.

According to preferred embodiments of the present invention, there is provided an isolated chimeric polypeptide encoding for an edge portion of T59832_P18 (SEQ ID NO: 782), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KC, having a structure as follows: a sequence starting from any of amino acid numbers 44−x to 44; and ending at any of amino acid numbers 45+((n−2)−x), in which x varies from 0 to n−2.

According to preferred embodiments of the present invention, there is provided an isolated chimeric polypeptide encoding for T59832_P18 (SEQ ID NO: 782), comprising a first amino acid sequence being at least 90% homologous to MTLSPLLLFLPPLLLLLDVPTAAVQAS-PLQALDFFGNGPPVNYK corresponding to amino acids 1-44 of Q8WU77, which also corresponds to amino acids 1-44 of T59832_P18 (SEQ ID NO: 782), and a second amino acid sequence being at least 90% homologous to CLQ-LYAPGLSPDTIMECAMGDRGMQLMHA-NAQRTDALQPPHEYVPWVTVNGKPLED QTQLLTLVCQLYQGKKPDVCPSSTSSLRSVCFK corresponding to amino acids 162-250 of Q8WU77, which also corresponds to amino acids 45-133 of T59832_P18 (SEQ ID NO: 782), wherein said first and second amino acid sequences are contiguous and in a sequential order.

According to preferred embodiments of the present invention, there is provided an isolated chimeric polypeptide encoding for an edge portion of T59832_P18 (SEQ ID NO: 782), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KC, having a structure as follows: a sequence starting from any of amino acid numbers 44−x to 44; and ending at any of amino acid numbers 45+((n−2)−x), in which x varies from 0 to n−2.

According to preferred embodiments of the present invention, there is provided an isolated chimeric polypeptide encoding for T59832_P18 (SEQ ID NO: 782), comprising a first amino acid sequence being at least 90% homologous to MTLSPLLLFLPPLLLLLDVPTAAVQAS-PLQALDFFGNGPPVNYK corresponding to amino acids 1-44 of Q8NEI4, which also corresponds to amino acids 1-44 of T59832_P18 (SEQ ID NO: 782), and a second amino acid sequence being at least 90% homologous to CLQLYAPGL-SPDTIMECAMGDRGMQLMHANAQRT-DALQPPHEYVPWVTVNGKPLED QTQLLTLVCQ-LYQGKKPDVCPSSTSSLRSVCFK corresponding to amino acids 162-250 of Q8NEI4, which also corresponds to amino acids 45-133 of T59832_P18 (SEQ ID NO: 782), wherein said first and second amino acid sequences are contiguous and in a sequential order.

According to preferred embodiments of the present invention, there is provided an isolated chimeric polypeptide encoding for an edge portion of T59832_P18 (SEQ ID NO: 782), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KC, having a structure as follows: a sequence starting from any of amino acid numbers 44−x to 44; and ending at any of amino acid numbers 45+((n−2)−x), in which x varies from 0 to n−2.

According to preferred embodiments of the present invention, there is provided an isolated chimeric polypeptide encoding for HUMGRP5E_P4 (SEQ ID NO: 108), comprising a first amino acid sequence being at least 90% homologous to MRGSELPLVLLALVLCLAPRGRAV-PLPAGGGTVLTKMYPRGNHWAVGHLMGKKSTG ESSSVSERGSLKQQLREYIRWEEAARN-LLGLIEAKENRNHQPPQPKALGNQQPSWDSED SSN-FKDVGSKGK corresponding to amino acids 1-127 of GRP_HUMAN, which also corresponds to amino acids 1-127 of HUMGRP5E_P4 (SEQ ID NO: 108), and a second amino acid sequence being at least 90% homologous to GSQREGRNPQLNQQ corresponding to amino acids 135-148 of GRP_HUMAN, which also corresponds to amino acids 128-141 of HUMGRP5E_P4 (SEQ ID NO: 108), wherein said first and second amino acid sequences are contiguous and in a sequential order.

According to preferred embodiments of the present invention, there is provided an isolated chimeric polypeptide encoding for an edge portion of HUMGRP5E_P4 (SEQ ID NO: 108), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KG, having a structure as follows: a sequence starting from any of amino acid numbers 127−x to 127; and ending at any of amino acid numbers 128+((n−2)−x), in which x varies from 0 to n−2.

According to preferred embodiments of the present invention, there is provided an isolated chimeric polypeptide encoding for HUMGRP5E_P5 (SEQ ID NO: 109), comprising a first amino acid sequence being at least 90% homologous to MRGSELPLVLLALVLCLAPRGRAV-PLPAGGGTVLTKMYPRGNHWAVGHLMGKKSTG ESSSVSERGSLKQQLREYIRWEEAARN-LLGLIEAKENRNHQPPQPKALGNQQPSWDSED SSN-FKDVGSKGK corresponding to amino acids 1-127 of GRP_HUMAN, which also corresponds to amino acids 1-127 of HUMGRP5E_P5 (SEQ ID NO: 109), and a second amino acid sequence being at least 70%, optionally at least 80%, preferably at least 85%, more preferably at least 90% and most preferably at least 95% homologous to a polypeptide having the sequence DSLLQVLNVKEGTPS (SEQ ID NO: 1125) corresponding to amino acids 128-142 of HUMGRP5E_P5 (SEQ ID NO: 109), wherein said first and second amino acid sequences are contiguous and in a sequential order.

According to preferred embodiments of the present invention, there is provided an isolated polypeptide encoding for a tail of HUMGRP5E_P5 (SEQ ID NO: 109), comprising a polypeptide being at least 70%, optionally at least about 80%, preferably at least about 85%, more preferably at least about 90% and most preferably at least about 95% homologous to the sequence DSLLQVLNVKEGTPS (SEQ ID NO: 1125) in HUMGRP5E_P5 (SEQ ID NO: 109).

According to preferred embodiments of the present invention, there is provided an isolated chimeric polypeptide encoding for R11723_PEA_1_P6 (SEQ ID NO: 143), comprising a first amino acid sequence being at least 70%, optionally at least 80%, preferably at least 85%, more preferably at least 90% and most preferably at least 95% homologous to a polypeptide having the sequence MWVLGIAATFCGLFLL-PGFALQIQCYQCEEFQLNNDC-SSPEFIVNCTVNVQDMCQKEV MEQSAGIMYRK-SCASSAACLIASAGSPCRGLAPGREEQRALHKAGAVG GGVR (SEQ ID NO: 1126) corresponding to amino acids 1-110 of R11723_PEA_1_P6 (SEQ ID NO: 143), and a second amino acid sequence being at least 90% homologous to MYAQALLVVGVLQRQAAAQHLHEHPP-KLLRGHRVQERVDDRAEVEKRLREGEEDHV RPEVG-PRPVVLGFGRSHDPPNLVGH-PAYGQCHNNQPWADTSRRERQRKEKHSMRTQ corresponding to amino acids 1-112 of Q8IXM0 (SEQ ID NO: 968), which also corresponds to amino acids 111-222 of R11723_PEA_1_P6 (SEQ ID NO: 143), wherein said first and second amino acid sequences are contiguous and in a sequential order.

According to preferred embodiments of the present invention, there is provided an isolated polypeptide encoding for a head of R11723_PEA_1_P6 (SEQ ID NO: 143), comprising a polypeptide being at least 70%, optionally at least about 80%, preferably at least about 85%, more preferably at least about 90% and most preferably at least about 95% homologous to the sequence MWVLGIAATFCGLFLLPGFALQIQ-CYQCEEFQLNNDCSSPEFIVNCTVNVQDMCQKEV MEQSAGIMYRKSCASSAACLIASAG-SPCRGLAPGREEQRALHKAGAVGGGVR (SEQ ID NO: 1126) of R11723_PEA_1_P6 (SEQ ID NO: 143).

According to preferred embodiments of the present invention, there is provided an isolated chimeric polypeptide encoding for R11723_PEA_1_P6 (SEQ ID NO: 143), comprising a first amino acid sequence being at least 90% homologous to MWVLGIAATFCGLFLLPGFALQIQCYQ-CEEFQLNNDCSSPEFIVNCTVNVQDMCQKEV MEQSAGIMYRKSCASSAACLIASAG corresponding to amino acids 1-83 of Q96AC2 (SEQ ID NO: 969), which also corresponds to amino acids 1-83 of R11723_PEA_1_P6 (SEQ ID NO: 143), and a second amino acid sequence being at least 70%, optionally at least 80%, preferably at least 85%, more preferably at least 90% and most preferably at least 95% homologous to a polypeptide having the sequence SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ (SEQ ID NO: 1127) corresponding to amino acids 84-222 of R11723_PEA_1_P6 (SEQ ID NO: 143), wherein said first and second amino acid sequences are contiguous and in a sequential order.

According to preferred embodiments of the present invention, there is provided an isolated polypeptide encoding for a tail of R11723_PEA_1_P6 (SEQ ID NO: 143), comprising a polypeptide being at least 70%, optionally at least about 80%, preferably at least about 85%, more preferably at least about 90% and most preferably at least about 95% homologous to the sequence SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ (SEQ ID NO: 1127) in R11723_PEA_1_P6 (SEQ ID NO: 143).

According to preferred embodiments of the present invention, there is provided an isolated chimeric polypeptide encoding for R11723_PEA_1_P6 (SEQ ID NO: 143), comprising a first amino acid sequence being at least 90% homologous to MWVLGIAATFCGLFLLPGFALQIQCYQCEEFQLNNDCSSPEFIVNCTVNVQDMCQKEV MEQSAGIMYRKSCASSAACLIASAG corresponding to amino acids 1-83 of Q8N2G4 (SEQ ID NO: 970), which also corresponds to amino acids 1-83 of R11723_PEA_1_P6 (SEQ ID NO: 143), and a second amino acid sequence being at least 70%, optionally at least 80%, preferably at least 85%, more preferably at least 90% and most preferably at least 95% homologous to a polypeptide having the sequence SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ (SEQ ID NO: 1127) corresponding to amino acids 84-222 of R11723_PEA_1_P6 (SEQ ID NO: 143), wherein said first and second amino acid sequences are contiguous and in a sequential order.

According to preferred embodiments of the present invention, there is provided an isolated polypeptide encoding for a tail of R11723_PEA_1_P6 (SEQ ID NO: 143), comprising a polypeptide being at least 70%, optionally at least about 80%, preferably at least about 85%, more preferably at least about 90% and most preferably at least about 95% homologous to the sequence SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ (SEQ ID NO: 1127) in R11723_PEA_1_P6 (SEQ ID NO: 143).

According to preferred embodiments of the present invention, there is provided an isolated chimeric polypeptide encoding for R11723_PEA_1_P6 (SEQ ID NO: 143), comprising a first amino acid sequence being at least 90% homologous to MWVLGIAATFCGLFLLPGFALQIQCYQCEEFQLNNDCSSPEFIVNCTVNVQDMCQKEV MEQSAGIMYRKSCASSAACLIASAG corresponding to amino acids 24-106 of BAC85518 (SEQ ID NO: 971), which also corresponds to amino acids 1-83 of R11723_PEA_1_P6 (SEQ ID NO: 143), and a second amino acid sequence being at least 70%, optionally at least 80%, preferably at least 85%, more preferably at least 90% and most preferably at least 95% homologous to a polypeptide having the sequence SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ (SEQ ID NO: 1127) corresponding to amino acids 84-222 of R11723_PEA_1_P6 (SEQ ID NO: 143), wherein said first and second amino acid sequences are contiguous and in a sequential order.

According to preferred embodiments of the present invention, there is provided an isolated polypeptide encoding for a tail of R11723_PEA_1_P6 (SEQ ID NO: 143), comprising a polypeptide being at least 70%, optionally at least about 80%, preferably at least about 85%, more preferably at least about 90% and most preferably at least about 95% homologous to the sequence SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ (SEQ ID NO: 1127) in R11723_PEA_1_P6 (SEQ ID NO: 143).

According to preferred embodiments of the present invention, there is provided an isolated chimeric polypeptide encoding for R11723_PEA_1_P7 (SEQ ID NO: 144), comprising a first amino acid sequence being at least 90% homologous to MWVLGIAATFCGLFLLPGFALQIQCYQCEEFQLNNDCSSPEFIVNCTVNVQDMCQKEV MEQSAG corresponding to amino acids 1-64 of Q96AC2 (SEQ ID NO: 969), which also corresponds to amino acids 1-64 of R11723_PEA_1_P7 (SEQ ID NO: 144), and a second amino acid sequence being at least 70%, optionally at least 80%, preferably at least 85%, more preferably at least 90% and most preferably at least 95% homologous to a polypeptide having the sequence SHCVTRLECSGTISAHCNLCLPGSNDHPT (SEQ ID NO: 1128) corresponding to amino acids 65-93 of R11723_PEA_1_P7 (SEQ ID NO: 144), wherein said first and second amino acid sequences are contiguous and in a sequential order.

According to preferred embodiments of the present invention, there is provided an isolated polypeptide encoding for a tail of R11723_PEA_1_P7 (SEQ ID NO: 144), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO: 1128) in R11723_PEA_1_P7 (SEQ ID NO: 144).

According to preferred embodiments of the present invention, there is provided an isolated chimeric polypeptide encoding for R11723_PEA_1_P7 (SEQ ID NO: 144), comprising a first amino acid sequence being at least 90% homologous to MWVLGIAATFCGLFLLPGFALQIQCYQCEEFQLNNDCSSPEFIVNCTVNVQDMCQKEV MEQSAG corresponding to amino acids 1-64 of Q8N2G4 (SEQ ID NO: 970), which also corresponds to amino acids 1-64 of R11723_PEA_1_P7 (SEQ ID NO: 144), and a second amino acid sequence being at least 70%, optionally at least 80%, preferably at least 85%, more preferably at least 90% and most preferably at least 95% homologous to a polypeptide having the sequence SHCVTRLECSGTISAH- CNLCLPGSNDHPT (SEQ ID NO: 1128) corresponding to amino acids 65-93 of R11723_PEA_1_P7 (SEQ ID NO: 144), wherein said first and second amino acid sequences are contiguous and in a sequential order.

According to preferred embodiments of the present invention, there is provided an isolated polypeptide encoding for a tail of R11723_PEA_1_P7 (SEQ ID NO: 144), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO: 1128) in R11723_PEA_1_P7 (SEQ ID NO: 144).

According to preferred embodiments of the present invention, there is provided an isolated chimeric polypeptide encoding for R11723_PEA_1_P7 (SEQ ID NO: 144), comprising a first amino acid sequence being at least 70%, optionally at least 80%, preferably at least 85%, more preferably at least 90% and most preferably at least 95% homologous to a polypeptide having the sequence MWVLG (SEQ ID NO: 1129) corresponding to amino acids 1-5 of R11723_PEA_1_P7 (SEQ ID NO: 144), second amino acid sequence being at least 90% homologous to IAATFCGLFLLPGFALQIQ-CYQCEEFQLNNDCSSPEFIVNCTVNVQD-MCQKEVMEQSAG corresponding to amino acids 22-80 of BAC85273 (SEQ ID NO: 972), which also corresponds to amino acids 6-64 of R11723_PEA_1_P7 (SEQ ID NO: 144), and a third amino acid sequence being at least 70%, optionally at least 80%, preferably at least 85%, more preferably at least 90% and most preferably at least 95% homologous to a polypeptide having the sequence SHCVTRLECSGTISAH-CNLCLPGSNDHPT (SEQ ID NO: 1128) corresponding to amino acids 65-93 of R11723_PEA_1_P7 (SEQ ID NO: 144), wherein said first, second and third amino acid sequences are contiguous and in a sequential order.

According to preferred embodiments of the present invention, there is provided an isolated polypeptide encoding for a head of R11723_PEA_1_P7 (SEQ ID NO: 144), comprising a polypeptide being at least 70%, optionally at least about 80%, preferably at least about 85%, more preferably at least about 90% and most preferably at least about 95% homologous to the sequence MWVLG (SEQ ID NO: 1129) of R11723_PEA_1_P7 (SEQ ID NO: 144).

According to preferred embodiments of the present invention, there is provided an isolated polypeptide encoding for a tail of R11723_PEA_1_P7 (SEQ ID NO: 144), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO: 1128) in R11723_PEA_1_P7 (SEQ ID NO: 144).

According to preferred embodiments of the present invention, there is provided an isolated chimeric polypeptide encoding for R11723_PEA_1_P7 (SEQ ID NO: 144), comprising a first amino acid sequence being at least 90% homologous to MWVLGIAATFCGLFLLPGFALQIQCYQ-CEEFQLNNDCSSPEFIVNCTVNVQDMCQKEV MEQSAG corresponding to amino acids 24-87 of BAC85518 (SEQ ID NO: 971), which also corresponds to amino acids 1-64 of R11723_PEA_1_P7 (SEQ ID NO: 144), and a second amino acid sequence being at least 70%, optionally at least 80%, preferably at least 85%, more preferably at least 90% and most preferably at least 95% homologous to a polypeptide having the sequence SHCVTRLECSGTISAH-CNLCLPGSNDHPT (SEQ ID NO: 1128) corresponding to amino acids 65-93 of R11723_PEA_1_P7 (SEQ ID NO: 144), wherein said first and second amino acid sequences are contiguous and in a sequential order.

According to preferred embodiments of the present invention, there is provided an isolated polypeptide encoding for a tail of R11723_PEA_1_P7 (SEQ ID NO: 144), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO: 1128) in R11723_PEA_1_P7 (SEQ ID NO: 144).

According to preferred embodiments of the present invention, there is provided an isolated chimeric polypeptide encoding for R11723_PEA_1_P13 (SEQ ID NO: 145), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q96AC2 (SEQ ID NO: 969), which also corresponds to amino acids 1-63 of R11723_PEA_1_P13 (SEQ ID NO: 145), and a second amino acid sequence being at least 70%, optionally at least 80%, preferably at least 85%, more preferably at least 90% and most preferably at least 95% homologous to a polypeptide having the sequence DTKRTNTLLFEM-RHFAKQLTT (SEQ ID NO: 1130) corresponding to amino acids 64-84 of R11723_PEA_1_P13 (SEQ ID NO: 145), wherein said first and second amino acid sequences are contiguous and in a sequential order.

According to preferred embodiments of the present invention, there is provided an isolated polypeptide encoding for a tail of R11723_PEA_1_P13 (SEQ ID NO: 145), comprising a polypeptide being at least 70%, optionally at least about 80%, preferably at least about 85%, more preferably at least about 90% and most preferably at least about 95% homologous to the sequence DTKRTNTLLFEMRHFAKQLTT (SEQ ID NO: 1130) in R11723_PEA_1_P13 (SEQ ID NO: 145).

According to preferred embodiments of the present invention, there is provided an isolated chimeric polypeptide encoding for R11723_PEA_1_P10 (SEQ ID NO: 146), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q96AC2 (SEQ ID NO: 969), which also corresponds to amino acids 1-63 of R11723_PEA_1_P10 (SEQ ID NO: 146), and a second amino acid sequence being at least 70%, optionally at least 80%, preferably at least 85%, more preferably at least 90% and most preferably at least 95% homologous to a polypeptide having the sequence DRVSLCHEAGVQWNN-FSTLQPLPPRLK (SEQ ID NO: 1131) corresponding to amino acids 64-90 of R11723_PEA_1_P10 (SEQ ID NO: 146), wherein said first and second amino acid sequences are contiguous and in a sequential order.

According to preferred embodiments of the present invention, there is provided an isolated polypeptide encoding for a tail of R11723_PEA_1_P10 (SEQ ID NO: 146), comprising a polypeptide being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO: 1131) in R11723_PEA_1_P10 (SEQ ID NO: 146).

According to preferred embodiments of the present invention, there is provided an isolated chimeric polypeptide encoding for R11723_PEA_1_P10 (SEQ ID NO: 146), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q8N2G4 (SEQ ID NO: 970), which also corresponds to amino acids 1-63 of R11723_PEA_1_P10 (SEQ ID NO: 146), and a second amino acid sequence being at least 70%, optionally at least 80%, preferably at least 85%, more preferably at least 90% and most preferably at least 95% homologous to a polypeptide having the sequence DRVSLCHEAGVQWNN-FSTLQPLPPRLK (SEQ ID NO: 1131) corresponding to amino acids 64-90 of R11723_PEA_1_P10 (SEQ ID NO: 146), wherein said first and second amino acid sequences are contiguous and in a sequential order.

According to preferred embodiments of the present invention, there is provided an isolated polypeptide encoding for a tail of R11723_PEA_1_P10 (SEQ ID NO: 146), comprising a polypeptide being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO: 1131) in R11723_PEA_1_P10(SEQ ID NO:146).

According to preferred embodiments of the present invention, there is provided an isolated chimeric polypeptide encoding for R11723_PEA_1_P10 (SEQ ID NO: 146), comprising a first amino acid sequence being at least 70%, optionally at least 80%, preferably at least 85%, more preferably at least 90% and most preferably at least 95% homologous to a polypeptide having the sequence MWVLG (SEQ ID NO: 1129) corresponding to amino acids 1-5 of R11723_PEA_1_P10 (SEQ ID NO: 146), second amino acid sequence being at least 90% homologous to IAATFCGLFLLPGFALQIQ-CYQCEEFQLNNDCSSPEFIVNCTVNVQD-MCQKEVMEQSA corresponding to amino acids 22-79 of BAC85273 (SEQ ID NO: 972), which also corresponds to amino acids 6-63 of R11723_PEA_1_P10 (SEQ ID NO: 146), and a third amino acid sequence being at least 70%, optionally at least 80%, preferably at least 85%, more preferably at least 90% and most preferably at least 95% homologous to a polypeptide having the sequence DRVS-LCHEAGVQWNNFSTLQPLPPRLK (SEQ ID NO: 1131) corresponding to amino acids 64-90 of R11723_PEA_1_P10 (SEQ ID NO: 146), wherein said first, second and third amino acid sequences are contiguous and in a sequential order.

According to preferred embodiments of the present invention, there is provided an isolated polypeptide encoding for a head of R11723_PEA_1_P10 (SEQ ID NO: 146), comprising a polypeptide being at least 70%, optionally at least about 80%, preferably at least about 85%, more preferably at least about 90% and most preferably at least about 95% homologous to the sequence MWVLG (SEQ ID NO: 1129) of R11723_PEA_1_P10 (SEQ ID NO: 146).

According to preferred embodiments of the present invention, there is provided an isolated polypeptide encoding for a tail of R11723_PEA_1_P10 (SEQ ID NO: 146), comprising a polypeptide being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO: 1131) in R11723_PEA_1_P10 (SEQ ID NO: 146).

According to preferred embodiments of the present invention, there is provided an isolated chimeric polypeptide encoding for R11723_PEA_1_P10 (SEQ ID NO: 146), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 24-86 of BAC85518 (SEQ ID NO: 971), which also corresponds to amino acids 1-63 of R11723_PEA_1_P10 (SEQ ID NO: 146), and a second amino acid sequence being at least 70%, optionally at least 80%, preferably at least 85%, more preferably at least 90% and most preferably at least 95% homologous to a polypeptide having the sequence DRVSLCHEAGVQWNN-FSTLQPLPPRLK (SEQ ID NO: 1131) corresponding to amino acids 64-90 of R11723_PEA_1_P10 (SEQ ID NO: 146), wherein said first and second amino acid sequences are contiguous and in a sequential order.

According to preferred embodiments of the present invention, there is provided an isolated polypeptide encoding for a tail of R11723_PEA_1_P10 (SEQ ID NO: 146), comprising a polypeptide being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO: 1131) in R11723_PEA_1_P10 (SEQ ID NO: 146).

According to preferred embodiments of the present invention, there is provided an isolated chimeric polypeptide encoding for D56406_PEA_1_P2 (SEQ ID NO: 161), comprising a first amino acid sequence being at least 90% homologous to MMAGMKIQLVCMLLLAFSSWSLCSD-SEEEMKALEADFLTNMHTSKISKAHVPSWKMT LLN-VCSLVNNLNSPAEETGEVHEEELVA-RRKLPTALDGFSLEAMLTIYQLHKICHSRAF QHWE corresponding to amino acids 1-120 of NEUT_HUMAN, which also corresponds to amino acids 1-120 of D56406_PEA_1_P2 (SEQ ID NO: 161), second amino acid sequence being at least 70%, optionally at least 80%, preferably at least 85%, more preferably at least 90% and most preferably at least 95% homologous to a polypeptide having the sequence ARWLTPVIPALWEAETGGSRGQEMETI-PANT (SEQ ID NO: 1141) corresponding to amino acids 121-151 of D56406_PEA_1_P2 (SEQ ID NO: 161), and a third amino acid sequence being at least 90% homologous to LIQEDILDTGNDKNGKEEVIKRKIPY-ILKRQLYENKPRRPYILKRDSYYY corresponding to amino acids 121-170 of NEUT_HUMAN, which also corresponds to amino acids 152-201 of D56406_PEA_1_P2 (SEQ ID NO: 161), wherein said first, second and third amino acid sequences are contiguous and in a sequential order.

According to preferred embodiments of the present invention, there is provided an isolated polypeptide encoding for an edge portion of D56406_PEA_1_P2 (SEQ ID NO: 161), comprising an amino acid sequence being at least 70%, optionally at least about 80%, preferably at least about 85%, more preferably at least about 90% and most preferably at least about 95% homologous to the sequence encoding for ARWLTPVIPALWEAETGGSRGQEMETIPANT (SEQ ID NO: 1141), corresponding to D56406_PEA_1_P2 (SEQ ID NO: 161).

According to preferred embodiments of the present invention, there is provided an isolated chimeric polypeptide encoding for D56406_PEA_1_P5 (SEQ ID NO: 162), comprising a first amino acid sequence being at least 90% homologous to MMAGMKIQLVCMLLLAFSSWSLC corresponding to amino acids 1-23 of NEUT_HUMAN, which also corresponds to amino acids 1-23 of D56406_PEA_1_P5 (SEQ ID NO: 162), and a second amino acid sequence being at least 90% homologous to SEEEMKALEADFLTNM-HTSKISKAHVPSWKMTLLNVCS-LVNNLNSPAEETGEVHEEEL VARRKLPTALDGFS-LEAMLTIYQLHKICHSRAFQHWELIQEDILDTGNDKN GKEEVIKR KIPYILKRQLYENKPRRPYILKRDSYYY corresponding to amino acids 26-170 of NEUT_HUMAN, which also corresponds to amino acids 24-168 of D56406_PEA_1_P5 (SEQ ID NO: 162), wherein said first and second amino acid sequences are contiguous and in a sequential order.

According to preferred embodiments of the present invention, there is provided an isolated chimeric polypeptide encoding for an edge portion of D56406_PEA_1_P5 (SEQ ID NO: 162), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise CS, having a structure as follows: a sequence starting from any of amino acid numbers 23−x to 24; and ending at any of amino acid numbers+((n−2)−x), in which x varies from 0 to n−2.

According to preferred embodiments of the present invention, there is provided an isolated chimeric polypeptide encoding for D56406_PEA_1_P6 (SEQ ID NO: 163), comprising a first amino acid sequence being at least 90% homologous to MMAGMKIQLVCMLLLAFSSWSLCSD-SEEEMKALEADFLTNMHTSK corresponding to amino acids 1-45 of NEUT_HUMAN, which also corresponds to amino acids 1-45 of D56406_PEA_1_P6 (SEQ ID NO: 163), and a second amino acid sequence being at least 90% homologous to LIQEDILDTGNDKNGKEEVIKRKIPY-ILKRQLYENKPRRPYILKRDSYYY corresponding to amino acids 121-170 of NEUT_HUMAN, which also corresponds to amino acids 46-95 of D56406_PEA_1_P6 (SEQ ID NO: 163), wherein said first and second amino acid sequences are contiguous and in a sequential order.

According to preferred embodiments of the present invention, there is provided an isolated chimeric polypeptide encoding for an edge portion of D56406_PEA_1_P6 (SEQ ID NO: 163), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KL, having a structure as follows: a sequence starting from any of amino acid numbers 45−x to 46; and ending at any of amino acid numbers 46+((n−2)−x), in which x varies from 0 to n−2.

According to preferred embodiments of the present invention, there is provided an isolated chimeric polypeptide encoding for H53393_PEA_1_P2 (SEQ ID NO: 185), comprising a first amino acid sequence being at least 90% homologous to MRTYRYFLLLFWVGQPYPTLSTPL-SKRTSGFPAKKRALELSGNSKNELNRSKRSWMWN QFFLLEEYTGSDYQYVGKLHS-DQDRGDGSLKYILSGDGAGDLFIINENT-GDIQATKRLD REEKPVYILRAQAINRRTGRPVEPE-SEFIIKIHDINDNEPIFTKEVYTATVPEMSDVGTFVV QVTATDADDPTYGNSAKV-VYSILQGQPYFSVESETGIIKTALLNM-DRENREQYQVVIQA KDMGGQMGGLSGTTTVNITLT-DVNDNPPRFPQSTYQFKTPESSPPGTPIGRIKASDADV GENAEIEYSITDGEGLDMFDVIT-DQETQEGIITVKKLLDFEKKKVYTLKVEASNPYVEPR FLYLGPFKDSATVRIVVEDVDEPPVF-SKLAYILQIREDAQINTTIGSVTAQDPDAARNPV KYS-VDRHTDMDRIFNIDSGNGSIFTSKLL-DRETLLWHNITVIATEINNPKQSSRVPLYIKV LDVNDNAPEFAEFYET-FVCEKAKADQLIQTLHAVDKDDPYS-GHQFSFSLAPEAASGSNF TIQDNK corresponding to amino acids 1-543 of CAD6_HUMAN, which also corresponds to amino acids 1-543 of H53393_PEA_1_P2 (SEQ ID NO: 185), and a second amino acid sequence being at least 70%, optionally at least 80%, preferably at least 85%, more preferably at least 90% and most preferably at least 95% homologous to a polypeptide having the sequence GK corresponding to amino acids 544-545 of H53393_PEA_1_P2 (SEQ ID NO: 185), wherein said first and second amino acid sequences are contiguous and in a sequential order.

According to preferred embodiments of the present invention, there is provided an isolated chimeric polypeptide encoding for H53393_PEA_1_P3 (SEQ ID NO: 186), comprising a first amino acid sequence being at least 90% homologous to MRTYRYFLLLFWVGQPYPTLSTPL-SKRTSGFPAKKRALELSGNSKNELNRSKRSWMWN QFFLLEEYTGSDYQYVGKLHS-DQDRGDGSLKYILSGDGAGDLFIINENT-GDIQATKRLD REEKPVYILRAQAINRRTGRPVEPE-SEFIIKIHDINDNEPIFTKEVYTATVPEMSDVGTFVV QVTATDADDPTYGNSAKV-VYSILQGQPYFSVESETGIIKTALLNM-DRENREQYQVVIQA KDMGGQMGGLSGTTTVNITLT-DVNDNPPRFPQSTYQFKTPESSPPGTPIGRIKASDADV GENAEIEYSITDGEGLDMFDVIT-DQETQEGIITVKKLLDFEKKKVYTLKVEASNPYVEPR FLYLGPFKDSATVRIVVEDVDEPPVF-SKLAYILQIREDAQINTTIGSVTAQDPDAARNPV KYS-VDRHTDMDRIFNIDSGNGSIFTSKLL-DRETLLWHNITVIATEINNPKQSSRVPLYIKV LDVNDNAPEFAEFYETFVCEKAKADQ corresponding to amino acids 1-504 of CAD6_HUMAN, which also corresponds to amino acids 1-504 of H53393_PEA_1_P3 (SEQ ID NO: 186), and a second amino acid sequence being at least 70%, optionally at least 80%, preferably at least 85%, more preferably at least 90% and most preferably at least 95% homologous to a polypeptide having the sequence RFGFSLS (SEQ ID NO: 1133) corresponding to amino acids 505-511 of H53393_PEA_1_P3 (SEQ ID NO: 186), wherein said first and second amino acid sequences are contiguous and in a sequential order.

According to preferred embodiments of the present invention, there is provided an isolated polypeptide encoding for a tail of H53393_PEA_1_P3 (SEQ ID NO: 186), comprising a polypeptide being at least 70%, optionally at least about 80%, preferably at least about 85%, more preferably at least about 90% and most preferably at least about 95% homologous to the sequence RFGFSLS (SEQ ID NO: 1133) in H53393_PEA_1_P3 (SEQ ID NO: 186).

According to preferred embodiments of the present invention, there is provided an isolated chimeric polypeptide encoding for H53393_PEA_1_P6 (SEQ ID NO: 187), comprising a first amino acid sequence being at least 90% homologous to MRTYRYFLLLFWVGQPYPTLSTPL-SKRTSGFPAKKRALELSGNSKNELNRSKRSWMWN QFFLLEEYTGSDYQYVGKLHS-DQDRGDGSLKYILSGDGAGDLFIINENT-GDIQATKRLD REEKPVYILRAQAINRRTGRPVEPE-SEFIIKIHDINDNEPIFTKEVYTATVPEMSDVGTFVV QVTATDADDPTYGNSAKV-VYSILQGQPYFSVESETGIIKTALLNM-DRENREQYQVVIQA KDMGGQMGGLSGTTTVNITLT-DVNDNPPRFPQSTYQFKTPESSPPGTPIGRIKASDADV GENAEIEYSITDGEGLDMFDVITDQETQEGIITVKK corresponding to amino acids 1-333 of CAD6_HUMAN, which also corresponds to amino acids 1-333 of H53393_PEA_1_P6 (SEQ ID NO: 187), and a second amino acid sequence being at least 70%, optionally at least 80%, preferably at least 85%, more preferably at least 90% and most preferably at least 95% homologous to a polypeptide having the sequence VMPLLKHHTE (SEQ ID NO: 1134) corresponding to amino acids 334-343 of H53393_PEA_1_P6 (SEQ ID NO: 187), wherein said first and second amino acid sequences are contiguous and in a sequential order.

According to preferred embodiments of the present invention, there is provided an isolated polypeptide encoding for a tail of H53393_PEA_1_P6 (SEQ ID NO: 187), comprising a polypeptide being at least 70%, optionally at least about 80%, preferably at least about 85%, more preferably at least about 90% and most preferably at least about 95% homologous to the sequence VMPLLKHHTE (SEQ ID NO: 1134) in H53393_PEA_1_P6 (SEQ ID NO: 187).

According to preferred embodiments of the present invention, there is provided an isolated chimeric polypeptide encoding for HSU40434_PEA_1_P12 (SEQ ID NO: 226), comprising a first amino acid sequence being at least 90% homologous to MALPTARPLLGSCGTPALGSLLFLLFS-LGWVQPSRTLAGETGQEAAPLDGVLANPPNISS LSPRQLLGFPCAEVSGLSTERVRELAVA-LAQKNVKLSTEQLRCLAHRLSEPPEDLDALP LDLLL-FLNPDAFSGPQACTRFFSRITKANVDLL-PRGAPERQRLLPAALACWGVRGSLLS EADVRALGGLACDLPGRFVAESAEVLL-PRLVSCPGPLDQDQQEAARAALQGGGPPYGP PSTWSVSTMDALRGLLPVLGQPIIR-SIPQGIVAAWRQRSSRDPSWRQPERTILRPRFRRE VEKTACPSGKKAREIDESLIFYKKWE-LEACVDAALLATQMDRVNAIPFTYEQLDVLKH KLDELYPQGYPESVIQHLGYLFLKMS-PEDIRKWNVTSLETLKALLEVNKGHEMSPQVA TLIDRFVKGRGQLDKDTLDTL-TAFYPGYLCSLSPEELSSVPPSSIW corresponding to amino acids 1-458 of Q14859 (SEQ ID NO: 985), which also corresponds to amino acids 1-458 of HSU40434_PEA_1_P12 (SEQ ID NO: 226).

According to preferred embodiments of the present invention, there is provided an isolated chimeric polypeptide encoding for HSU40434_PEA_1_P12 (SEQ ID NO: 226), comprising a first amino acid sequence being at least 90% homologous to MALPTARPLLGSCGTPALGSLLFLLFS-LGWVQPSRTLAGETGQ corresponding to amino acids 1-43 of Q9BTR2 (SEQ ID NO: 986), which also corresponds to amino acids 1-43 of HSU40434_PEA_1_P12 (SEQ ID NO: 226), second amino acid sequence being at least 70%, optionally at least 80%, preferably at least 85%, more preferably at least 90% and most preferably at least 95% homologous to a polypeptide having the sequence E corresponding to amino acids 44-44 of HSU40434_PEA_1_P12 (SEQ ID NO: 226), and a third amino acid sequence being at least 90% homologous to AAPLDGVLANPPNISSLSPRQLLGFP-CAEVSGLSTERVRELAVALAQKNVKLSTEQLRC LAHRLSEPPEDLDALPLDLLLFLNPDAF-SGPQACTRFFSRITKANVDLLPRGAPERQRLL PAA-LACWGVRGSLLSEADVRALGGLA-CDLPGRFVAESAEVLLPRLVSCPGPLDQDQQE AARAALQGGGPPYGPPSTWSVSTMDALR-GLLPVLGQPIIRSIPQGIVAAWRQRSSRDPS WRQPER-TILRPRFRREVEKTACPSGKKAREIDES-LIFYKKWELEACVDAALLATQMDRV NAIPFTYEQLDVLKHKLDELYPQGYPES-VIQHLGYLFLKMSPEDIRKWNVTSLETLKAL LEVNKGHEMSPQVATLIDRFVKGRGQLD-KDTLDTLTAFYPGYLCSLSPEELSSVPPSSIW corresponding to amino acids 44-457 of Q9BTR2 (SEQ ID NO: 986), which also corresponds to amino acids 45-458 of HSU40434_PEA_1_P12 (SEQ ID NO: 226), wherein said first, second and third amino acid sequences are contiguous and in a sequential order.

According to preferred embodiments of the present invention, there is provided an isolated polypeptide encoding for an edge portion of HSU40434_PEA_1_P12 (SEQ ID NO: 226), comprising an amino acid sequence being at least 70%, optionally at least about 80%, preferably at least about 85%, more preferably at least about 90% and most preferably at least about 95% homologous to the sequence encoding for E, corresponding to HSU40434_PEA_1_P12 (SEQ ID NO: 226).

According to preferred embodiments of the present invention, there is provided an isolated chimeric polypeptide encoding for M77904_P2 (SEQ ID NO: 252), comprising a first amino acid sequence being at least 90% homologous to MLSIKSGERIVFTFSCQSPENHFVIE-IQKNIDCMSGPCPFGEVQLQPSTSLLPTLNRTFIWD VKAHKSIGLELQFSIPRLRQIGPGESCP-DGVTHSISGRIDATVVRIGTFCSNGTVSRIKMQ EGVKMALHLPWFHPRNVSGFSIAN-RSSIKRLCIIESVFEGEGSATLMSANYPEGFPEDEL MTWQFVVPAHLRASVSFLNFNLSNCER-KEERVEYYIPGSTTNPEVFKLEDKQPGNMAG NFNLSLQGCDQDAQSPGILRLQFQVLVQHPQNES corresponding to amino acids 67-341 of Q8WU91 (SEQ ID NO: 987), which also corresponds to amino acids 1-275 of M77904_P2 (SEQ ID NO: 252), and a second amino acid sequence being at least 70%, optionally at least 80%, preferably at least 85%, more preferably at least 90% and most preferably at least 95% homologous to a polypeptide having the sequence NKIYVVDLSNERAMSLTIEPRPVKQSRK-FVPGCFVCLESRTCSSNLTLTSGSKHKISFLCD DLTRL-WMNVEKTISCTDHRYCQRKSYSLQVPS-DILHLPVELHDFSWKLLVPKDRLSLVL VPAQKLQQHTHEKPCNTSFSYLVA-SAIPSQDLYFGSFCPGGSIKQIQVKQNISVTLRTFAP SFQQEASRQGLTVSFIPYFKEEGVFTVT-PDTKSKVYLRTPNWDRGLPSLTSVSWNISVPR DQVA-CLTFFKERSGVVCQTGRAFMIIQEQR-TRAEEIFSLDEDVLPKPSFHHHSFWVNISN CSPTSGKQLDLLFSVTLTPRTVDLTVIL-IAAVGGGVLLLSALGLIICCVKKKKKKTNKGP AVGIYNGNINTEMPRQPKKFQKGRKDND-SHVYAVIEDTMVYGHLLQDSSGSFLQPEVD TYR-PFQGTMGVCPPSPPTICSRAPTAKLA-TEEPPPRSPPESESEPYTFSHPNNGDVSSKDT DIPLLNTQEPMEPAE (SEQ ID NO: 1135) corresponding to amino acids 276-770 of M77904_P2 (SEQ ID NO: 252), wherein said first and second amino acid sequences are contiguous and in a sequential order.

According to preferred embodiments of the present invention, there is provided an isolated polypeptide encoding for a tail of M77904_P2 (SEQ ID NO: 252), comprising a polypeptide being at least 70%, optionally at least about 80%, preferably at least about 85%, more preferably at least about 90% and most preferably at least about 95% homologous to the sequence NKIYVVDLSNERAMSLTIEPRPVKQSRK-FVPGCFVCLESRTCSSNLTLTSGSKHKISFLCD DLTRL-WMNVEKTISCTDHRYCQRKSYSLQVPS-DILHLPVELHDFSWKLLVPKDRLSLVL VPAQKLQQHTHEKPCNTSFSYLVA-SAIPSQDLYFGSFCPGGSIKQIQVKQNISVTLRTFAP SFQQEASRQGLTVSFIPYFKEEGVFTVT- PDTKSKVYLRTPNWDRGLPSLTSVSWNISVPR DQVACLTFFKERSGVVCQTGRAFMIIQEQRTRAEEIFSLDEDVLPKPSFHHHSFWVNISN CSPTSGKQLDLLFSVTLTPRTVDLTVILIAAVGGGVLLLSALGLIICCVKKKKKKTNKGP AVGIYNGNINTEMPRQPKKFQKGRKDNDSHVYAVIEDTMVYGHLLQDSSGSFLQPEVD TYRPFQGTMGVCPPSPPTICSRAPTAKLATEEPPPRSPPESESEPYTFSHPNNGDVSSKDT DIPLLNTQEPMEPAE (SEQ ID NO: 1135) in M77904_P2 (SEQ ID NO: 252).

According to preferred embodiments of the present invention, there is provided an isolated chimeric polypeptide encoding for M77904_P2 (SEQ ID NO: 252), comprising a first amino acid sequence being at least 90% homologous to MLSIKSGERIVFTFSCQSPENHFVIEIQKNIDCMSGPCPFGEVQLQPSTSLLPTLNRTFIWD VKAHKSIGLELQFSIPRLRQIGPGESCPDGVTHSISGRIDATVVRIGTFCSNGTVSRIKMQ EGVKMALHLPWFHPRNVSGFSIANRSSIKRLCIIESVFEGEGSATLMSANYPEGFPEDEL MTWQFVVPAHLRASVSFLNFNLSNCERKEERVEYYIPGSTTNPEVFKLEDKQPGNMAG NFNLSLQGCDQDAQSPGILRLQFQVLVQHPQNESNKIYVVDLSNERAMSLTIEPRPVKQ SRKFVPGCFVCLESRTCSSNLTLTSGSKHKISFLCDDLTRLWMNVEKTISCTDHRYCQR KSYSLQVPSDILHLPVELHDFSWKLLVPKDRLSLVLVPAQKLQQHTHEKPCNTSFSYLV ASAIPSQDLYFGSFCPGGSIKQIQVKQNISVTLRTFAPSFQQEASRQGLTVSFIPYFKEEGV FTVTPDTKSKVYLRTPNWDRGLPSLTSVSWNISVPRDQVACLTFFKERSGVVC QTGRAF MIIQEQRTRAEEIFSLDEDVLPKPSFHHHSFWVNISNCSPTSGKQLDLLFSVTLTPRTVDL TVILIAAVGGGVLLLSALGLIICCVKKKKKKTNKGPAVGIYNGNINTEMPRQPKKFQKG RKDNDSHVYAVIEDTMVYGHLLQDSSGSFLQPEVDTYRPFQGTMGVCPPSPP TICSRAP TAKLATEEPPPRSPPESESEPYTFSHPNNGDVSSKDTDIPLLNTQEPMEPAE (SEQ ID NO: 1135) corresponding to amino acids 67-836 of Q96QU7 (SEQ ID NO: 988), which also corresponds to amino acids 1-770 of M77904_P2 (SEQ ID NO: 252).

According to preferred embodiments of the present invention, there is provided an isolated chimeric polypeptide encoding for M77904_P4 (SEQ ID NO: 253), comprising a first amino acid sequence being at least 90% homologous to MAGLNCGVSIALLGVLLLGAARLPRGAEAFEIALPRESNITVLIKLGTPTLLAKPCYIVIS KRHITMLSIKSGERIVFTFSCQSPENHFVIEIQKNIDCMSGPCPFGEVQLQPSTSLLPTLNR TFIWDVKAHKSIGLELQFSIPRLRQIGPGESCPDGVTHSISGRIDATVVRIGTFCSNGTVSR IKMQEGVKMALHLPWFHPRNVSGFSIANRSSIKRLCIIESVFEGEGSATLMSANYPEGFP EDELMTWQFVVPAHLRASVSFLNFNLSNCERKEERVEYYIPGSTTNPEVFKLEDKQPGN MAGNFNLSLQGCDQDAQSPGILRLQFQVLVQHPQNES corresponding to amino acids 1-341 of Q8WU91 (SEQ ID NO: 987), which also corresponds to amino acids 1-341 of M77904_P4 (SEQ ID NO: 253), and a second amino acid sequence being at least 70%, optionally at least 80%, preferably at least 85%, more preferably at least 90% and most preferably at least 95% homologous to a polypeptide having the sequence NKIYVVDLSNERAMSLTIEPRPVKQSRKFVPGCFVCLESRTCSSNLTLTSGSKHKISFLCD DLTRLWMNVEKTISTPLNQCICPWPWIALLSPPCLSGVPWVGCKSYQKGPSGRARWLT PVIPALWEAKAGGSLEVRSSRPAWPTW (SEQ ID NO: 1136) corresponding to amino acids 342-487 of M77904_P4 (SEQ ID NO: 253), wherein said first and second amino acid sequences are contiguous and in a sequential order.

According to preferred embodiments of the present invention, there is provided an isolated polypeptide encoding for a tail of M77904_P4 (SEQ ID NO: 253), comprising a polypeptide being at least 70%, optionally at least about 80%, preferably at least about 85%, more preferably at least about 90% and most preferably at least about 95% homologous to the sequence NKIYVVDLSNERAMSLTIEPRPVKQSRKFVPGCFVCLESRTCSSNLTLTSGSKHKISFLCD DLTRLWMNVEKTISTPLNQCICPWPWIALLSPPCLSGVPWVGCKSYQKGPSGRARWLT PVIPALWEAKAGGSLEVRSSRPAWPTW (SEQ ID NO: 1136) in M77904_P4 (SEQ ID NO: 253).

According to preferred embodiments of the present invention, there is provided an isolated chimeric polypeptide encoding for M77904_P4 (SEQ ID NO: 253), comprising a first amino acid sequence being at least 90% homologous to MAGLNCGVSIALLGVLLLGAARLPRGAEAFEIALPRESNITVLIKLGTPTLLAKPCYIVIS KRHITMLSIKSGERIVFTFSCQSPENHFVIEIQKNIDCMSGPCPFGEVQLQPSTSLLPTLNR TFIWDVKAHKSIGLELQFSIPRLRQIGPGESCPDGVTHSISGRIDATVVRIGTFCSNGTVSR IKMQEGVKMALHLPWFHPRNVSGFSIANRSSIKRLCIIESVFEGEGSATLMSANYPEGFP EDELMTWQFVVPAHLRASVSFLNFNLSNCERKEERVEYYIPGSTTNPEVFKLEDKQPGN MAGNFNLSLQGCDQDAQSPGILRLQFQVLVQHPQNESNKIYVVDLSNERAMSLTIEPRP VKQSRKFVPGCFVCLESRTCSSNLTLTSGSKHKISFLCDDLTRLWMNVEKTIS corresponding to amino acids 1-416 of Q9H5V8 (SEQ ID NO: 989), which also corresponds to amino acids 1-416 of M77904_P4 (SEQ ID NO: 253), and a second amino acid sequence being at least 70%, optionally at least 80%, preferably at least 85%, more preferably at least 90% and most preferably at least 95% homologous to a polypeptide having the sequence TPLNQCICPWPWIALLSPPCLSGVPWVGCKSYQKGPSGRARWLTPVIPALWEAKAGGS LEVRSSRPAWPTW corresponding to amino acids 417-487 of M77904_P4 (SEQ ID NO: 253), wherein said first and second amino acid sequences are contiguous and in a sequential order.

According to preferred embodiments of the present invention, there is provided an isolated polypeptide encoding for a tail of M77904_P4 (SEQ ID NO: 253), comprising a polypeptide being at least 70%, optionally at least about 80%, preferably at least about 85%, more preferably at least about 90% and most preferably at least about 95% homologous to the sequence TPLNQCICPWPWIALLSPPCLSGVPWVGCKSYQKGPSGRARWLTPVIPALWEAKAGGS LEVRSSRPAWPTW in M77904_P4 (SEQ ID NO: 253).

According to preferred embodiments of the present invention, there is provided an isolated chimeric polypeptide encoding for M77904_P4 (SEQ ID NO: 253), comprising a first amino acid sequence being at least 90% homologous to MAGLNCGVSIALLGVLLLGAARLPRGAEAFEIALPRESNITVLIKLGTPTLLAKPCYIVIS KRHITMLSIKSGERIVFTFSCQSPENHFVIEIQKNIDCMSGPCPFGEVQLQPSTSLLPTLNR TFIWDVKAHKSIGLELQFSIPRLRQIGPGESCPDGVTHSISGRIDATVVRIGTFCSNGTVSR IKMQEGVKMALHLPWFHPRNVSGFSIAN-RSSIKRLCIIESVFEGEGSATLMSANYPEGFP EDELMTWQFVVPAHLRASVSFLNFNL-SNCERKEERVEYYIPGSTTNPEVFKLEDKQPGN MAGNFNLSLQGCDQDAQSPGILRLQFQV-LVQHPQNESNKIYVVDLSNERAMSLTIEPRP VKQSRKFVPGCFVCLESRTCSSN-LTLTSGSKHKISFLCDDLTRLWMNVEKTIS corresponding to amino acids 1-416 of Q96QU7 (SEQ ID NO: 988), which also corresponds to amino acids 1-416 of M77904_P4 (SEQ ID NO: 253), and a second amino acid sequence being at least 70%, optionally at least 80%, preferably at least 85%, more preferably at least 90% and most preferably at least 95% homologous to a polypeptide having the sequence TPLNQCICPWPWIALLSPPCLSGVP-WVGCKSYQKGPSGRARWLTPVIPALWEAKAGGS LEVRSSRPAWPTW corresponding to amino acids 417-487 of M77904_P4 (SEQ ID NO: 253), wherein said first and second amino acid sequences are contiguous and in a sequential order.

According to preferred embodiments of the present invention, there is provided an isolated polypeptide encoding for a tail of M77904_P4 (SEQ ID NO: 253), comprising a polypeptide being at least 70%, optionally at least about 80%, preferably at least about 85%, more preferably at least about 90% and most preferably at least about 95% homologous to the sequence TPLNQCICPWPWIALLSPPCLSGVP-WVGCKSYQKGPSGRARWLTPVIPALWEAKAGGS LEVRSSRPAWPTW in M77904_P4 (SEQ ID NO: 253).

According to preferred embodiments of the present invention, there is provided an isolated chimeric polypeptide encoding for M77904_P5 (SEQ ID NO: 254), comprising a first amino acid sequence being at least 90% homologous to MIIQEQRTRAEEIFSLDEDVLPKPSFH-HHSFWVNISNCSPTSGKQLDLLFSVTLTPRTVDL TVILIAAVGGGVLLLSALGLIIC-CVKKKKKKTNKGPAVGIYNGNINTEM-PRQPKKFQKG RKDNDSHVYAVIEDTM-VYGHLLQDSSGSFLQPEVDTYRPFQGTMGVCPPSPP TICSRAP TAKLATEEPPPRSPPESESEPYTFSHPN-NGDVSSKDTDIPLLNTQEPMEPAE corresponding to amino acids 606-836 of Q96QU7 (SEQ ID NO: 988), which also corresponds to amino acids 1-231 of M77904_P5 (SEQ ID NO: 254).

According to preferred embodiments of the present invention, there is provided an isolated chimeric polypeptide encoding for M77904_P5 (SEQ ID NO: 254), comprising a first amino acid sequence being at least 90% homologous to MIIQEQRTRAEEIFSLDEDVLPKPSFH-HHSFWVNISNCSPTSGKQLDLLFSVTLTPRTVDL TVILIAAVGGGVLLLSALGLIIC-CVKKKKKKTNKGPAVGIYNGNINTEM-PRQPKKFQKG RKDNDSHVYAVIEDTM-VYGHLLQDSSGSFLQPEVDTYRPFQGTMGVCPPSPP TICSRAP TAKLATEEPPPRSPPESESEPYTFSHPN-NGDVSSKDTDIPLLNTQEPMEPAE corresponding to amino acids 419-649 of Q9H8C2 (SEQ ID NO: 990), which also corresponds to amino acids 1-231 of M77904_P5 (SEQ ID NO: 254).

According to preferred embodiments of the present invention, there is provided an isolated chimeric polypeptide encoding for M77904_P7 (SEQ ID NO: 255), comprising a first amino acid sequence being at least 90% homologous to MAGLNCGVSIALLGVLLLGAARLPRGAE-AFEIALPRESNITVLIKLGTPTLLAKPCYIVIS KRHIT-MLSIKSGERIVFTFSCQSPENHFVIE-IQKNIDCMSGPCPFGEVQLQPSTSLLPTLNR TFIWDVKAHKSIGLELQFSIPRLRQIG-PGESCPDGVTHSISGRIDATVVRIGTFCSNGTVSR IKMQEGVKMALHLPWFHPRNVSGFSIANRSSIKR corresponding to amino acids 1-219 of Q8WU91 (SEQ ID NO: 987), which also corresponds to amino acids 1-219 of M77904_P7 (SEQ ID NO: 255), and a second amino acid sequence being at least 70%, optionally at least 80%, preferably at least 85%, more preferably at least 90% and most preferably at least 95% homologous to a polypeptide having the sequence EKAPPCYLIRLKHTRSSLF (SEQ ID NO: 1137) corresponding to amino acids 220-238 of M77904_P7 (SEQ ID NO: 255), wherein said first and second amino acid sequences are contiguous and in a sequential order.

According to preferred embodiments of the present invention, there is provided an isolated polypeptide encoding for a tail of M77904_P7 (SEQ ID NO: 255), comprising a polypeptide being at least 70%, optionally at least about 80%, preferably at least about 85%, more preferably at least about 90% and most preferably at least about 95% homologous to the sequence EKAPPCYLIRLKHTRSSLF (SEQ ID NO: 1137) in M77904_P7 (SEQ ID NO: 255).

According to preferred embodiments of the present invention, there is provided an isolated chimeric polypeptide encoding for M77904_P7 (SEQ ID NO: 255), comprising a first amino acid sequence being at least 90% homologous to MAGLNCGVSIALLGVLLLGAARLPRGAE-AFEIALPRESNITVLIKLGTPTLLAKPCYIVIS KRHIT-MLSIKSGERIVFTFSCQSPENHFVIE-IQKNIDCMSGPCPFGEVQLQPSTSLLPTLNR TFIWDVKAHKSIGLELQFSIPRLRQIG-PGESCPDGVTHSISGRIDATVVRIGTFCSNGTVSR IKMQEGVKMALHLPWFHPRNVSGFSIANRSSIKR corresponding to amino acids 1-219 of Q9H5V8 (SEQ ID NO: 989), which also corresponds to amino acids 1-219 of M77904_P7 (SEQ ID NO: 255), and a second amino acid sequence being at least 70%, optionally at least 80%, preferably at least 85%, more preferably at least 90% and most preferably at least 95% homologous to a polypeptide having the sequence EKAPPCYLIRLKHTRSSLF (SEQ ID NO: 1137) corresponding to amino acids 220-238 of M77904_P7 (SEQ ID NO: 255), wherein said first and second amino acid sequences are contiguous and in a sequential order.

According to preferred embodiments of the present invention, there is provided an isolated polypeptide encoding for a tail of M77904_P7 (SEQ ID NO: 255), comprising a polypeptide being at least 70%, optionally at least about 80%, preferably at least about 85%, more preferably at least about 90% and most preferably at least about 95% homologous to the sequence EKAPPCYLIRLKHTRSSLF (SEQ ID NO: 1137) in M77904_P7 (SEQ ID NO: 255).

According to preferred embodiments of the present invention, there is provided an isolated chimeric polypeptide encoding for M77904_P7 (SEQ ID NO: 255), comprising a first amino acid sequence being at least 90% homologous to MAGLNCGVSIALLGVLLLGAARLPRGAE-AFEIALPRESNITVLIKLGTPTLLAKPCYIVIS KRHIT-MLSIKSGERIVFTFSCQSPENHFVIE-IQKNIDCMSGPCPFGEVQLQPSTSLLPTLNR TFIWDVKAHKSIGLELQFSIPRLRQIG-PGESCPDGVTHSISGRIDATVVRIGTFCSNGTVSR IKMQEGVKMALHLPWFHPRNVSGFSIANRSSIKR corresponding to amino acids 1-219 of Q96QU7 (SEQ ID NO: 988), which also corresponds to amino acids 1-219 of M77904_P7 (SEQ ID NO: 255), and a second amino acid sequence being at least 70%, optionally at least 80%, preferably at least 85%, more preferably at least 90% and most preferably at least 95% homologous to a polypeptide having the sequence EKAPPCYLIRLKHTRSSLF (SEQ ID NO: 1137) corresponding to amino acids 220-238 of M77904_P7 (SEQ ID NO: 255), wherein said first and second amino acid sequences are contiguous and in a sequential order.

According to preferred embodiments of the present invention, there is provided an isolated polypeptide encoding for a tail of M77904_P7 (SEQ ID NO: 255), comprising a polypeptide being at least 70%, optionally at least about 80%, preferably at least about 85%, more preferably at least about 90% and most preferably at least about 95% homologous to the sequence EKAPPCYLIRLKHTRSSLF (SEQ ID NO: 1137) in M77904_P7 (SEQ ID NO: 255).

According to preferred embodiments of the present invention, there is provided an isolated chimeric polypeptide encoding for Z25299_PEA__2_P2 (SEQ ID NO: 273), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNPTRRK-PGKCPVTYGQCLMLNPPNFCEMDGQCKRDLK CCMGMCGKSCVSPVK corresponding to amino acids 1-131 of ALK1_HUMAN, which also corresponds to amino acids 1-131 of Z25299_PEA__2_P2 (SEQ ID NO: 273), and a second amino acid sequence being at least 70%, optionally at least 80%, preferably at least 85%, more preferably at least 90% and most preferably at least 95% homologous to a polypeptide having the sequence GKQGMRAH (SEQ ID NO: 1138) corresponding to amino acids 132-139 of Z25299_PEA__2_P2 (SEQ ID NO: 273), wherein said first and second amino acid sequences are contiguous and in a sequential order.

According to preferred embodiments of the present invention, there is provided an isolated polypeptide encoding for a tail of Z25299_PEA__2_P2 (SEQ ID NO: 273), comprising a polypeptide being at least 70%, optionally at least about 80%, preferably at least about 85%, more preferably at least about 90% and most preferably at least about 95% homologous to the sequence GKQGMRAH (SEQ ID NO: 1138) in Z25299_PEA__2_P2 (SEQ ID NO: 273).

According to preferred embodiments of the present invention, there is provided an isolated chimeric polypeptide encoding for Z25299_PEA__2_P3 (SEQ ID NO: 274), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNPTRRK-PGKCPVTYGQCLMLNPPNFCEMDGQCKRDLK CCMGMCGKSCVSPVK corresponding to amino acids 1-131 of ALK1_HUMAN, which also corresponds to amino acids 1-131 of Z25299_PEA__2_P3 (SEQ ID NO: 274), and a second amino acid sequence being at least 70%, optionally at least 80%, preferably at least 85%, more preferably at least 90% and most preferably at least 95% homologous to a polypeptide having the sequence GEKRHHKQLRDQEVD-PLEMRRHSAG (SEQ ID NO: 1139) corresponding to amino acids 132-156 of Z25299_PEA__2_P3 (SEQ ID NO: 274), wherein said first and second amino acid sequences are contiguous and in a sequential order.

According to preferred embodiments of the present invention, there is provided an isolated polypeptide encoding for a tail of Z25299_PEA__2_P3 (SEQ ID NO: 274), comprising a polypeptide being at least 70%, optionally at least about 80%, preferably at least about 85%, more preferably at least about 90% and most preferably at least about 95% homologous to the sequence GEKRHHKQLRDQEVDPLEMRRHSAG (SEQ ID NO: 1139) in Z25299_PEA__2_P3 (SEQ ID NO: 274).

According to preferred embodiments of the present invention, there is provided an isolated chimeric polypeptide encoding for Z25299_PEA__2_P7 (SEQ ID NO: 275), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNP corresponding to amino acids 1-81 of ALK1_HUMAN, which also corresponds to amino acids 1-81 of Z25299_PEA__2_P7 (SEQ ID NO: 275), and a second amino acid sequence being at least 70%, optionally at least 80%, preferably at least 85%, more preferably at least 90% and most preferably at least 95% homologous to a polypeptide having the sequence RGSLGSAQ (SEQ ID NO: 1140) corresponding to amino acids 82-89 of Z25299_PEA__2_P7 (SEQ ID NO: 275), wherein said first and second amino acid sequences are contiguous and in a sequential order.

According to preferred embodiments of the present invention, there is provided an isolated polypeptide encoding for a tail of Z25299_PEA__2_P7 (SEQ ID NO: 275), comprising a polypeptide being at least 70%, optionally at least about 80%, preferably at least about 85%, more preferably at least about 90% and most preferably at least about 95% homologous to the sequence RGSLGSAQ (SEQ ID NO: 1140) in Z25299_PEA__2_P7 (SEQ ID NO: 275).

According to preferred embodiments of the present invention, there is provided an isolated chimeric polypeptide encoding for Z25299_PEA__2_P10 (SEQ ID NO: 276), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNPT corresponding to amino acids 1-82 of ALK1_HUMAN, which also corresponds to amino acids 1-82 of Z25299_PEA__2_P10 (SEQ ID NO: 276).

According to preferred embodiments of the present invention, there is provided an antibody capable of specifically binding to an epitope of an amino acid sequence as described herein.

Optionally the amino acid sequence corresponds to a bridge, edge portion, tail, head or insertion as described herein.

Optionally the antibody is capable of differentiating between a splice variant having said epitope and a corresponding known protein.

According to preferred embodiments of the present invention, there is provided a kit for detecting ovarian cancer, comprising a kit detecting overexpression of a splice variant as described herein.

Optionally the kit comprises a NAT-based technology.

Optionally the kit further comprises at least one primer pair capable of selectively hybridizing to a nucleic acid sequence as described herein.

Optionally the kit further comprises at least one oligonucleotide capable of selectively hybridizing to a nucleic acid sequence as described herein.

Optionally the kit comprises an antibody as described herein.

Optionally the kit further comprises at least one reagent for performing an ELISA or a Western blot.

According to preferred embodiments of the present invention, there is provided a method for detecting ovarian cancer, comprising detecting overexpression of a splice variant as described herein.

Optionally detecting overexpression is performed with a NAT-based technology.

Optionally detecting overexpression is performed with an immunoassay.

Optionally the immunoassay comprises an antibody as described herein.

According to preferred embodiments of the present invention, there is provided a biomarker capable of detecting ovarian cancer, comprising any of the above nucleic acid sequences or a fragment thereof, or any of the above amino acid sequences or a fragment thereof.

According to preferred embodiments of the present invention, there is provided a method for screening for ovarian cancer, comprising detecting ovarian cancer cells with a biomarker or an antibody or a method or assay as described herein.

According to preferred embodiments of the present invention, there is provided a method for diagnosing ovarian cancer, comprising detecting ovarian cancer cells with a biomarker or an antibody or a method or assay as described herein.

According to preferred embodiments of the present invention, there is provided a method for monitoring disease progression and/or treatment efficacy and/or relapse of ovarian cancer, comprising detecting ovarian cancer cells with a biomarker or an antibody or a method or assay as described herein.

According to preferred embodiments of the present invention, there is provided a method of selecting a therapy for ovarian cancer, comprising detecting ovarian cancer cells with a biomarker or an antibody or a method or assay as described herein and selecting a therapy according to said detection.

According to preferred embodiments of the present invention, preferably any of the above nucleic acid and/or amino acid sequences further comprises any sequence having at least about 70%, preferably at least about 80%, more preferably at least about 90%, most preferably at least about 95% homology thereto.

Unless otherwise noted, all experimental data relates to variants of the present invention, named according to the segment being tested (as expression was tested through RT-PCR as described).

All nucleic acid sequences and/or amino acid sequences shown herein as embodiments of the present invention relate to their isolated form, as isolated polynucleotides (including for all transcripts), oligonucleotides (including for all segments, amplicons and primers), peptides (including for all tails, bridges, insertions or heads, optionally including other antibody epitopes as described herein) and/or polypeptides (including for all proteins). It should be noted that oligonucleotide and polynucleotide, or peptide and polypeptide, may optionally be used interchangeably.

BRIEF DESCRIPTION OF DRAWINGS

FIG. 1 is schematic summary of cancer biomarkers selection engine and the wet validation stages.

FIG. 2. Schematic illustration, depicting grouping of transcripts of a given cluster based on presence or absence of unique sequence regions.

FIG. 3 is schematic summary of quantitative real-time PCR analysis.

FIG. 4 is schematic presentation of the oligonucleotide based microarray fabrication.

FIG. 5 is schematic summary of the oligonucleotide based microarray experimental flow.

FIG. 6 shows cancer and cell-line vs. normal tissue expression for.

DESCRIPTION OF PREFERRED EMBODIMENTS

Figure 7:
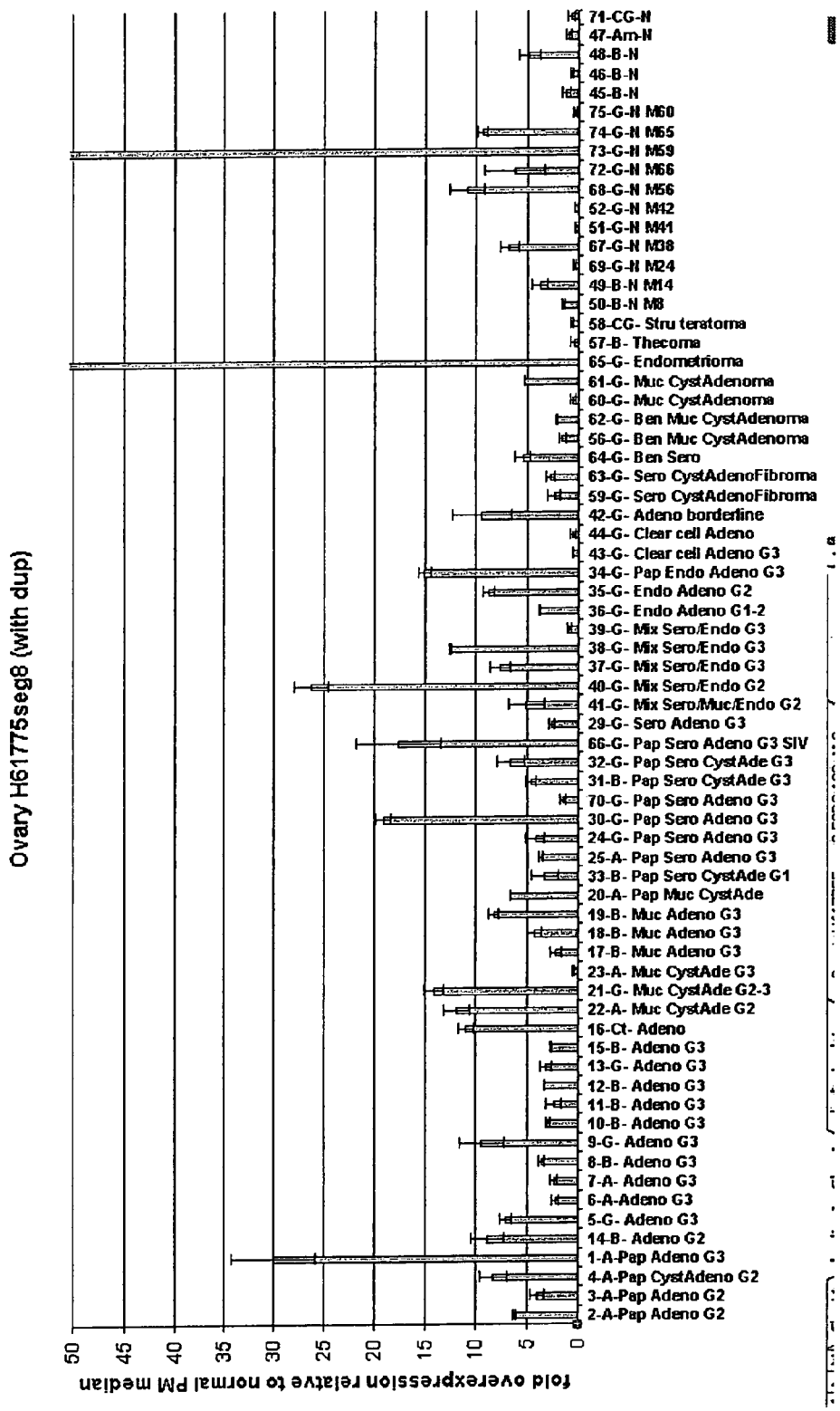
FIG. 7 shows expression of segment8 in H61775 in cancerous vs. non-cancerous tissues.

The present invention is of novel markers for ovarian cancer that are both sensitive and accurate. Biomolecular sequences (amino acid and/or nucleic acid sequences) uncovered using the methodology of the present invention and described herein can be efficiently utilized as tissue or pathological markers and/or as drugs or drug targets for treating or preventing a disease.

Furthermore, at least certain of these markers are able to distinguish between various types of ovarian cancer, such as Ovarian epithelial tumors (serous, mucinous, endometroid, clear cell, and Brenner tumor), ovarian germ-cell tumors, (teratoma, dysgerminoma, endodermal sinus tumor, and embryonal carcinoma) and ovarian stromal tumors (originating from granulosa, theca, Sertoli, Leydig, and collagen-producing stromal cells), alone or in combination. These markers are differentially expressed, and preferably overexpressed in ovarian cancer specifically, as opposed to normal ovarian tissue. The measurement of these markers, alone or in combination, in patient samples provides information that the diagnostician can correlate with a probable diagnosis of ovarian cancer. The markers of the present invention, alone or in combination, show a high degree of differential detection between ovarian cancer and non-cancerous states.

The markers of the present invention, alone or in combination, can be used for prognosis, prediction, screening, early diagnosis, staging, therapy selection and treatment monitoring of ovarian cancer. For example, optionally and preferably, these markers may be used for staging ovarian cancer and/or monitoring the progression of the disease. Furthermore, the markers of the present invention, alone or in combination, can be used for detection of the source of metastasis found in anatomical places other thenovary. Also, one or more of the markers may optionally be used in combination with one or more other ovarian cancer markers (other than those described herein). According to an optional embodiment of the present invention, such a combination may be used to differentiate between various types of ovarian cancer, such as Ovarian epithelial tumors (serous, mucinous, endometroid, clear cell, and Brenner tumor), ovarian germ-cell tumors, (teratoma, dysgerminoma, endodermal sinus tumor, and embryonal carcinoma) and ovarian stromal tumors (originating from either granulosa, theca, Sertoli, Leydig, and collagen-producing stromal cells).

These markers are specifically released to the bloodstream under conditions of ovarian cancer (or one of the above indicative conditions), and/or are otherwise expressed at a much higher level and/or specifically expressed in ovarian cancer tissue or cells, and/or tissue or cells under one of the above indicative conditions. The measurement of these markers, alone or in combination, in patient samples provides information that the diagnostician can correlate with a probable diagnosis of ovarian cancer and/or a condition that it is indicative of a higher risk for ovarian cancer.

The present invention therefore also relates to diagnostic assays for ovarian cancer, and methods of use of such markers for detection of ovarian cancer, optionally and preferably in a sample taken from a subject (patient), which is more preferably some type of blood sample.

In another embodiment, the present invention relates to bridges, tails, heads and/or insertions, and/or analogs, homologs and derivatives of such peptides. Such bridges, tails, heads and/or insertions are described in greater detail below with regard to the Examples.

As used herein a "tail" refers to a peptide sequence at the end of an amino acid sequence that is unique to a splice variant according to the present invention. Therefore, a splice variant having such a tail may optionally be considered as a chimera, in that at least a first portion of the splice variant is typically highly homologous (often 100% identical) to a portion of the corresponding known protein, while at least a second portion of the variant comprises the tail.

As used herein a "head" refers to a peptide sequence at the beginning of an amino acid sequence that is unique to a splice variant according to the present invention. Therefore, a splice variant having such a head may optionally be considered as a chimera, in that at least a first portion of the splice variant comprises the head, while at least a second portion is typically highly homologous (often 100% identical) to a portion of the corresponding known protein.

As used herein "an edge portion" refers to a connection between two portions of a splice variant according to the present invention that were not joined in the wild type or known protein. An edge may optionally arise due to a join between the above "known protein" portion of a variant and the tail, for example, and/or may occur if an internal portion of the wild type sequence is no longer present, such that two portions of the sequence are now contiguous in the splice variant that were not contiguous in the known protein. A "bridge" may optionally be an edge portion as described above, but may also include a join between a head and a "known protein" portion of a variant, or a join between a tail and a "known protein" portion of a variant, or a join between an insertion and a "known protein" portion of a variant.

Optionally and preferably, a bridge between a tail or a head or a unique insertion, and a "known protein" portion of a variant, comprises at least about 10 amino acids, more preferably at least about 20 amino acids, most preferably at least about 30 amino acids, and even more preferably at least about 40 amino acids, in which at least one amino acid is from the tail/head/insertion and at least one amino acid is from the "known protein" portion of a variant. Also optionally, the bridge may comprise any number of amino acids from about 10 to about 40 amino acids (for example, 10, 11, 12, 13 . . . 37, 38, 39, 40 amino acids in length, or any number in between).

It should be noted that a bridge cannot be extended beyond the length of the sequence in either direction, and it should be assumed that every bridge description is to be read in such manner that the bridge length does not extend beyond the sequence itself.

Furthermore, bridges are described with regard to a sliding window in certain contexts below. For example, certain descriptions of the bridges feature the following format: a bridge between two edges (in which a portion of the known protein is not present in the variant) may optionally be described as follows: a bridge portion of CONTIG-NAME_P1 (representing the name of the protein), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise XX (2 amino acids in the center of the bridge, one from each end of the edge), having a structure as follows (numbering according to the sequence of CONTIG-NAME_P1): a sequence starting from any of amino acid numbers 49–x to 49 (for example); and ending at any of amino acid numbers 50+((n−2)−x) (for example), in which x varies from 0 to n−2. In this example, it should also be read as including bridges in which n is any number of amino acids between 10-50 amino acids in length. Furthermore, the bridge polypeptide cannot extend beyond the sequence, so it should be read such that 49–x (for example) is not less than 1, nor 50+((n−2)−x) (for example) greater than the total sequence length.

In another embodiment, this invention provides antibodies specifically recognizing the splice variants and polypeptide fragments thereof of this invention. Preferably such antibodies differentially recognize splice variants of the present invention but do not recognize a corresponding known protein (such known proteins are discussed with regard to their splice variants in the Examples below).

In another embodiment, this invention provides an isolated nucleic acid molecule encoding for a splice variant according to the present invention, having a nucleotide sequence as set forth in any one of the sequences listed herein, or a sequence complementary thereto. In another embodiment, this invention provides an isolated nucleic acid molecule, having a nucleotide sequence as set forth in any one of the sequences listed herein, or a sequence complementary thereto. In another embodiment, this invention provides an oligonucleotide of at least about 12 nucleotides, specifically hybridizable with the nucleic acid molecules of this invention. In another embodiment, this invention provides vectors, cells, liposomes and compositions comprising the isolated nucleic acids of this invention.

In another embodiment, this invention provides a method for detecting a splice variant according to the present invention in a biological sample, comprising: contacting a biological sample with an antibody specifically recognizing a splice variant according to the present invention under conditions whereby the antibody specifically interacts with the splice variant in the biological sample but do not recognize known corresponding proteins (wherein the known protein is discussed with regard to its splice variant(s) in the Examples below), and detecting said interaction; wherein the presence of an interaction correlates with the presence of a splice variant in the biological sample.

In another embodiment, this invention provides a method for detecting a splice variant nucleic acid sequences in a biological sample, comprising: hybridizing the isolated nucleic acid molecules or oligonucleotide fragments of at least about a minimum length to a nucleic acid material of a biological sample and detecting a hybridization complex; wherein the presence of a hybridization complex correlates with the presence of a splice variant nucleic acid sequence in the biological sample.

According to the present invention, the splice variants described herein are non-limiting examples of markers for diagnosing ovarian cancer. Each splice variant marker of the present invention can be used alone or in combination, for various uses, including but not limited to, prognosis, prediction, screening, early diagnosis, determination of progression, therapy selection and treatment monitoring of ovarian cancer.

According to optional but preferred embodiments of the present invention, any marker according to the present invention may optionally be used alone or combination. Such a combination may optionally comprise a plurality of markers described herein, optionally including any subcombination of markers, and/or a combination featuring at least one other marker, for example a known marker. Furthermore, such a combination may optionally and preferably be used as described above with regard to determining a ratio between a quantitative or semi-quantitative measurement of any marker described herein to any other marker described herein, and/or any other known marker, and/or any other marker. With regard to such a ratio between any marker described herein (or a combination thereof) and a known marker, more preferably the known marker comprises the "known protein" as described in greater detail below with regard to each cluster or gene.

According to other preferred embodiments of the present invention, a splice variant protein or a fragment thereof, or a splice variant nucleic acid sequence or a fragment thereof, may be featured as a biomarker for detecting ovarian cancer and/or an indicative condition, such that a biomarker may optionally comprise any of the above.

According to still other preferred embodiments, the present invention optionally and preferably encompasses any amino acid sequence or fragment thereof encoded by a nucleic acid sequence corresponding to a splice variant protein as described herein. Any oligopeptide or peptide relating to such an amino acid sequence or fragment thereof may optionally also (additionally or alternatively) be used as a biomarker, including but not limited to the unique amino acid sequences of these proteins that are depicted as tails, heads, insertions, edges or bridges. The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to a splice variant of the present invention as described above, optionally for any application.

Non-limiting examples of methods or assays are described below.

The present invention also relates to kits based upon such diagnostic methods or assays.

Nucleic Acid Sequences and Oligonucleotides

Various embodiments of the present invention encompass nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or artificially induced, either randomly or in a targeted fashion.

The present invention encompasses nucleic acid sequences described herein; fragments thereof, sequences hybridizable therewith, sequences homologous thereto [e.g., at least 50%, at least 55%, at least 60%, at least 65%, at least 70%, at least 75%, at least 80%, at least 85%, at least 95% or more say 100% identical to the nucleic acid sequences set forth below], sequences encoding similar polypeptides with different codon usage, altered sequences characterized by mutations, such as deletion, insertion or substitution of one or more nucleotides, either naturally occurring or man induced, either randomly or in a targeted fashion. The present invention also encompasses homologous nucleic acid sequences (i.e., which form a part of a polynucleotide sequence of the present invention) which include sequence regions unique to the polynucleotides of the present invention.

In cases where the polynucleotide sequences of the present invention encode previously unidentified polypeptides, the present invention also encompasses novel polypeptides or portions thereof, which are encoded by the isolated polynucleotide and respective nucleic acid fragments thereof described hereinabove.

A "nucleic acid fragment" or an "oligonucleotide" or a "polynucleotide" are used herein interchangeably to refer to a polymer of nucleic acids. A polynucleotide sequence of the present invention refers to a single or double stranded nucleic acid sequences which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is composed of genomic and cDNA sequences. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Preferred embodiments of the present invention encompass oligonucleotide probes.

An example of an oligonucleotide probe which can be utilized by the present invention is a single stranded polynucleotide which includes a sequence complementary to the unique sequence region of any variant according to the present invention, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Alternatively, an oligonucleotide probe of the present invention can be designed to hybridize with a nucleic acid sequence encompassed by any of the above nucleic acid sequences, particularly the portions specified above, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Oligonucleotides designed according to the teachings of the present invention can be generated according to any oligonucleotide synthesis method known in the art such as enzymatic synthesis or solid phase synthesis. Equipment and reagents for executing solid-phase synthesis are commercially available from, for example, Applied Biosystems. Any other means for such synthesis may also be employed; the actual synthesis of the oligonucleotides is well within the capabilities of one skilled in the art and can be accomplished via established methodologies as detailed in, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988) and "Oligonucleotide Synthesis" Gait, M. J., ed. (1984) utilizing solid phase chemistry, e.g. cyanoethyl phosphoramidite followed by deprotection, desalting and purification by for example, an automated trityl-on method or HPLC.

Oligonucleotides used according to this aspect of the present invention are those having a length selected from a range of about 10 to about 200 bases preferably about 15 to about 150 bases, more preferably about 20 to about 100 bases, most preferably about 20 to about 50 bases. Preferably, the oligonucleotide of the present invention features at least 17, at least 18, at least 19, at least 20, at least 22, at least 25, at least 30 or at least 40, bases specifically hybridizable with the biomarkers of the present invention.

The oligonucleotides of the present invention may comprise heterocylic nucleosides consisting of purines and the pyrimidines bases, bonded in a 3' to 5' phosphodiester linkage.

Preferably used oligonucleotides are those modified at one or more of the backbone, internucleoside linkages or bases, as is broadly described hereinunder.

Specific examples of preferred oligonucleotides useful according to this aspect of the present invention include oligonucleotides containing modified backbones or non-natural internucleoside linkages. Oligonucleotides having modified backbones include those that retain a phosphorus atom in the backbone, as disclosed in U.S. Pat. Nos. 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

Preferred modified oligonucleotide backbones include, for example, phosphorothioates, chiral phosphorothioates, phosphorodithioates, phosphotriesters, aminoalkyl phosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms can also be used.

Alternatively, modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts, as disclosed in U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439.

Other oligonucleotides which can be used according to the present invention, are those modified in both sugar and the internucleoside linkage, i.e., the backbone, of the nucleotide units are replaced with novel groups. The base units are maintained for complementation with the appropriate polynucleotide target. An example for such an oligonucleotide mimetic, includes peptide nucleic acid (PNA). United States patents that teach the preparation of PNA compounds include, but are not limited to, U.S. Pat. Nos. 5,539,082; 5,714,331; and 5,719,262, each of which is herein incorporated by reference. Other backbone modifications, which can be used in the present invention are disclosed in U.S. Pat. No. 6,303,374.

Oligonucleotides of the present invention may also include base modifications or substitutions. As used herein, "unmodified" or "natural" bases include the purine bases adenine (A) and guanine (G), and the pyrimidine bases thymine (T), cytosine (C) and uracil (U). Modified bases include but are not limited to other synthetic and natural bases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further bases particularly useful for increasing the binding affinity of the oligomeric compounds of the invention include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2° C. and are presently preferred base substitutions, even more particularly when combined with 2'-O-methoxyethyl sugar modifications.

Another modification of the oligonucleotides of the invention involves chemically linking to the oligonucleotide one or more moieties or conjugates, which enhance the activity, cellular distribution or cellular uptake of the oligonucleotide. Such moieties include but are not limited to lipid moieties such as a cholesterol moiety, cholic acid, a thioether, e.g., hexyl-S-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxycholesterol moiety, as disclosed in U.S. Pat. No. 6,303,374.

It is not necessary for all positions in a given oligonucleotide molecule to be uniformly modified, and in fact more than one of the aforementioned modifications may be incorporated in a single compound or even at a single nucleoside within an oligonucleotide.

It will be appreciated that oligonucleotides of the present invention may include further modifications for more efficient use as diagnostic agents and/or to increase bioavailability, therapeutic efficacy and reduce cytotoxicity.

To enable cellular expression of the polynucleotides of the present invention, a nucleic acid construct according to the present invention may be used, which includes at least a coding region of one of the above nucleic acid sequences, and further includes at least one cis acting regulatory element. As used herein, the phrase "cis acting regulatory element" refers to a polynucleotide sequence, preferably a promoter, which binds a trans acting regulator and regulates the transcription of a coding sequence located downstream thereto.

Any suitable promoter sequence can be used by the nucleic acid construct of the present invention.

Preferably, the promoter utilized by the nucleic acid construct of the present invention is active in the specific cell population transformed. Examples of cell type-specific and/or tissue-specific promoters include promoters such as albumin that is liver specific, lymphoid specific promoters [Calame et al., (1988) Adv. Immunol. 43:235-275]; in particular promoters of T-cell receptors [Winoto et al., (1989) EMBO J. 8:729-733] and immunoglobulins; [Banerji et al. (1983) Cell 33729-740], neuron-specific promoters such as the neurofilament promoter [Byrne et al. (1989) Proc. Natl. Acad. Sci. USA 86:5473-5477], pancreas-specific promoters [Edlunch et al. (1985) Science 230:912-916] or mammary gland-specific promoters such as the milk whey promoter (U.S. Pat. No. 4,873,316 and European Application Publication No. 264, 166). The nucleic acid construct of the present invention can further include an enhancer, which can be adjacent or distant to the promoter sequence and can function in up regulating the transcription therefrom.

The nucleic acid construct of the present invention preferably further includes an appropriate selectable marker and/or an origin of replication. Preferably, the nucleic acid construct utilized is a shuttle vector, which can propagate both in *E. coli* (wherein the construct comprises an appropriate selectable marker and origin of replication) and be compatible for propagation in cells, or integration in a gene and a tissue of choice. The construct according to the present invention can be, for example, a plasmid, a bacmid, a phagemid, a cosmid, a phage, a virus or an artificial chromosome.

Examples of suitable constructs include, but are not limited to, pcDNA3, pcDNA3.1 (+/-), pGL3, PzeoSV2 (+/-), pDisplay, pEF/myc/cyto, pCMV/myc/cyto each of which is commercially available from Invitrogen Co. (invitrogen.com). Examples of retroviral vector and packaging systems are those sold by Clontech, San Diego, Calif., including Retro-X vectors pLNCX and pLXSN, which permit cloning into multiple cloning sites and the transgene is transcribed from CMV promoter. Vectors derived from Mo-MuLV are also included such as pBabe, where the transgene will be transcribed from the 5'LTR promoter.

Currently preferred in vivo nucleic acid transfer techniques include transfection with viral or non-viral constructs, such as adenovirus, lentivirus, Herpes simplex I virus, or adeno-associated virus (AAV) and lipid-based systems. Useful lipids for lipid-mediated transfer of the gene are, for example, DOTMA, DOPE, and DC-Chol [Tonkinson et al., Cancer Investigation, 14(1): 54-65 (1996)]. The most preferred constructs for use in gene therapy are viruses, most preferably adenoviruses, AAV, lentiviruses, or retroviruses. A viral construct such as a retroviral construct includes at least one transcriptional promoter/enhancer or locus-defining element(s), or other elements that control gene expression by other means such as alternate splicing, nuclear RNA export, or post-translational modification of messenger. Such vector constructs also include a packaging signal, long terminal repeats (LTRs) or portions thereof, and positive and negative strand primer binding sites appropriate to the virus used, unless it is already present in the viral construct. In addition, such a construct typically includes a signal sequence for secretion of the peptide from a host cell in which it is placed. Preferably the signal sequence for this purpose is a mammalian signal sequence or the signal sequence of the polypeptide variants of the present invention. Optionally, the construct may also include a signal that directs polyadenylation, as well as one or more restriction sites and a translation termination sequence. By way of example, such constructs will typically include a 5' LTR, a tRNA binding site, a packaging signal, an origin of second-strand DNA synthesis, and a 3' LTR or a portion thereof. Other vectors can be used that are non-viral, such as cationic lipids, polylysine, and dendrimers.

Hybridization Assays

Detection of a nucleic acid of interest in a biological sample may optionally be effected by hybridization-based assays using an oligonucleotide probe (non-limiting examples of probes according to the present invention were previously described).

Traditional hybridization assays include PCR, RT-PCR, Real-time PCR, RNase protection, in-situ hybridization, primer extension, Southern blots (DNA detection), dot or slot blots (DNA, RNA), and Northern blots (RNA detection) (NAT type assays are described in greater detail below). More recently, PNAs have been described (Nielsen et al. 1999, Current Opin. Biotechnol. 10:71-75). Other detection methods include kits containing probes on a dipstick setup and the like.

Hybridization based assays which allow the detection of a variant of interest (i.e., DNA or RNA) in a biological sample rely on the use of oligonucleotides which can be 10, 15, 20, or 30 to 100 nucleotides long preferably from 10 to 50, more preferably from 40 to 50 nucleotides long.

Thus, the isolated polynucleotides (oligonucleotides) of the present invention are preferably hybridizable with any of the herein described nucleic acid sequences under moderate to stringent hybridization conditions.

Moderate to stringent hybridization conditions are characterized by a hybridization solution such as containing 10% dextrane sulfate, 1 M NaCl, 1% SDS and $5 \times 10^6$ cpm $^{32}$P labeled probe, at 65° C., with a final wash solution of 0.2× SSC and 0.1% SDS and final wash at 65° C. and whereas moderate hybridization is effected using a hybridization solution containing 10% dextrane sulfate, 1 M NaCl, 1% SDS and $5 \times 10^6$ cpm $^{32}$P labeled probe, at 65° C., with a final wash solution of 1×SSC and 0.1% SDS and final wash at 50° C.

More generally, hybridization of short nucleic acids (below 200 bp in length, e.g. 17-40 bp in length) can be effected using the following exemplary hybridization protocols which can be modified according to the desired stringency; (i) hybridization solution of 6×SSC and 1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 1-1.5° C. below the $T_m$, final wash solution of 3 M TMACl, 0.01 M sodium phosphate (pH 6.8), 1 mM EDTA (pH 7.6), 0.5% SDS at 1-1.5° C. below the $T_m$; (ii) hybridization solution of 6×SSC and 0.1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 2-2.5° C. below the $T_m$, final wash solution of 3 M TMACl, 0.01 M sodium phosphate (pH 6.8), 1 mM EDTA (pH 7.6), 0.5% SDS at 1-1.5° C. below the $T_m$, final wash solution of 6×SSC, and final wash at 22° C.; (iii) hybridization solution of 6×SSC and 1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature.

The detection of hybrid duplexes can be carried out by a number of methods. Typically, hybridization duplexes are separated from unhybridized nucleic acids and the labels bound to the duplexes are then detected. Such labels refer to radioactive, fluorescent, biological or enzymatic tags or labels of standard use in the art. A label can be conjugated to either the oligonucleotide probes or the nucleic acids derived from the biological sample.

Probes can be labeled according to numerous well known methods. Non-limiting examples of radioactive labels include 3H, 14C, 32P, and 35S. Non-limiting examples of detectable markers include ligands, fluorophores, chemiluminescent agents, enzymes, and antibodies. Other detectable markers for use with probes, which can enable an increase in sensitivity of the method of the invention, include biotin and radio-nucleotides. It will become evident to the person of ordinary skill that the choice of a particular label dictates the manner in which it is bound to the probe.

For example, oligonucleotides of the present invention can be labeled subsequent to synthesis, by incorporating biotinylated dNTPs or rNTP, or some similar means (e.g., photo-cross-linking a psoralen derivative of biotin to RNAs), followed by addition of labeled streptavidin (e.g., phycoerythrin-conjugated streptavidin) or the equivalent. Alternatively, when fluorescently-labeled oligonucleotide probes are used, fluorescein, lissamine, phycoerythrin, rhodamine (Perkin Elmer Cetus), Cy2, Cy3, Cy3.5, Cy5, Cy5.5, Cy7, FluorX (Amersham) and others [e.g., Kricka et al. (1992), Academic Press San Diego, Calif] can be attached to the oligonucleotides.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays. For instance, samples may be hybridized to an irrelevant probe and treated with RNAse A prior to hybridization, to assess false hybridization.

Although the present invention is not specifically dependent on the use of a label for the detection of a particular nucleic acid sequence, such a label might be beneficial, by increasing the sensitivity of the detection. Furthermore, it enables automation. Probes can be labeled according to numerous well known methods.

As commonly known, radioactive nucleotides can be incorporated into probes of the invention by several methods. Non-limiting examples of radioactive labels include $^3$H, $^{14}$C, $^{32}$P, and $^{35}$S.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays.

Probes of the invention can be utilized with naturally occurring sugar-phosphate backbones as well as modified backbones including phosphorothioates, dithionates, alkyl phosphonates and a-nucleotides and the like. Probes of the invention can be constructed of either ribonucleic acid (RNA) or deoxyribonucleic acid (DNA), and preferably of DNA.

NAT Assays

Detection of a nucleic acid of interest in a biological sample may also optionally be effected by NAT-based assays, which involve nucleic acid amplification technology, such as PCR for example (or variations thereof such as real-time PCR for example).

As used herein, a "primer" defines an oligonucleotide which is capable of annealing to (hybridizing with) a target sequence, thereby creating a double stranded region which can serve as an initiation point for DNA synthesis under suitable conditions.

Amplification of a selected, or target, nucleic acid sequence may be carried out by a number of suitable methods. See generally Kwoh et al., 1990, Am. Biotechnol. Lab. 8:14 Numerous amplification techniques have been described and can be readily adapted to suit particular needs of a person of ordinary skill. Non-limiting examples of amplification techniques include polymerase chain reaction (PCR), ligase chain reaction (LCR), strand displacement amplification (SDA), transcription-based amplification, the q3 replicase system and NASBA (Kwoh et al., 1989, Proc. Natl. Acad. Sci. USA 86, 1173-1177; Lizardi et al., 1988, BioTechnology 6:1197-1202; Malek et al., 1994, Methods Mol. Biol., 28:253-260; and Sambrook et al., 1989, supra).

The terminology "amplification pair" (or "primer pair") refers herein to a pair of oligonucleotides (oligos) of the present invention, which are selected to be used together in amplifying a selected nucleic acid sequence by one of a number of types of amplification processes, preferably a polymerase chain reaction. Other types of amplification processes include ligase chain reaction, strand displacement amplification, or nucleic acid sequence-based amplification, as explained in greater detail below. As commonly known in the art, the oligos are designed to bind to a complementary sequence under selected conditions.

In one particular embodiment, amplification of a nucleic acid sample from a patient is amplified under conditions which favor the amplification of the most abundant differentially expressed nucleic acid. In one preferred embodiment, RT-PCR is carried out on an mRNA sample from a patient under conditions which favor the amplification of the most abundant mRNA. In another preferred embodiment, the amplification of the differentially expressed nucleic acids is carried out simultaneously. It will be realized by a person skilled in the art that such methods could be adapted for the detection of differentially expressed proteins instead of differentially expressed nucleic acid sequences.

The nucleic acid (i.e. DNA or RNA) for practicing the present invention may be obtained according to well known methods.

Oligonucleotide primers of the present invention may be of any suitable length, depending on the particular assay format and the particular needs and targeted genomes employed. Optionally, the oligonucleotide primers are at least 12 nucleotides in length, preferably between 15 and 24 molecules, and they may be adapted to be especially suited to a chosen nucleic acid amplification system. As commonly known in the art, the oligonucleotide primers can be designed by taking into consideration the melting point of hybridization thereof with its targeted sequence (Sambrook et al., 1989, Molecular Cloning—A Laboratory Manual, 2nd Edition, CSH Laboratories; Ausubel et al., 1989, in Current Protocols in Molecular Biology, John Wiley & Sons Inc., N.Y.).

It will be appreciated that antisense oligonucleotides may be employed to quantify expression of a splice isoform of interest. Such detection is effected at the pre-mRNA level. Essentially the ability to quantitate transcription from a splice site of interest can be effected based on splice site accessibility. Oligonucleotides may compete with splicing factors for the splice site sequences. Thus, low activity of the antisense oligonucleotide is indicative of splicing activity.

The polymerase chain reaction and other nucleic acid amplification reactions are well known in the art (various non-limiting examples of these reactions are described in greater detail below). The pair of oligonucleotides according to this aspect of the present invention are preferably selected to have compatible melting temperatures (Tm), e.g., melting temperatures which differ by less than that 7° C., preferably less than 5° C., more preferably less than 4° C., most preferably less than 3° C., ideally between 3° C. and 0° C.

Polymerase Chain Reaction (PCR): The polymerase chain reaction (PCR), as described in U.S. Pat. Nos. 4,683,195 and 4,683,202 to Mullis and Mullis et al., is a method of increasing the concentration of a segment of target sequence in a mixture of genomic DNA without cloning or purification. This technology provides one approach to the problems of low target sequence concentration. PCR can be used to directly increase the concentration of the target to an easily detectable level. This process for amplifying the target sequence involves the introduction of a molar excess of two oligonucleotide primers which are complementary to their respective strands of the double-stranded target sequence to the DNA mixture containing the desired target sequence. The mixture is denatured and then allowed to hybridize. Following hybridization, the primers are extended with polymerase so as to form complementary strands. The steps of denaturation, hybridization (annealing), and polymerase extension (elongation) can be repeated as often as needed, in order to obtain relatively high concentrations of a segment of the desired target sequence.

The length of the segment of the desired target sequence is determined by the relative positions of the primers with respect to each other, and, therefore, this length is a controllable parameter. Because the desired segments of the target sequence become the dominant sequences (in terms of concentration) in the mixture, they are said to be "PCR-amplified."

Ligase Chain Reaction (LCR or LAR): The ligase chain reaction [LCR; sometimes referred to as "Ligase Amplification Reaction" (LAR)] has developed into a well-recognized alternative method of amplifying nucleic acids. In LCR, four oligonucleotides, two adjacent oligonucleotides which uniquely hybridize to one strand of target DNA, and a complementary set of adjacent oligonucleotides, which hybridize to the opposite strand are mixed and DNA ligase is added to the mixture. Provided that there is complete complementarity at the junction, ligase will covalently link each set of hybridized molecules. Importantly, in LCR, two probes are ligated together only when they base-pair with sequences in the target sample, without gaps or mismatches. Repeated cycles of denaturation, and ligation amplify a short segment of DNA. LCR has also been used in combination with PCR to achieve enhanced detection of single-base changes: see for example Segev, PCT Publication No. WO9001069 A1 (1990). However, because the four oligonucleotides used in this assay can pair to form two short ligatable fragments, there is the potential for the generation of target-independent background signal. The use of LCR for mutant screening is limited to the examination of specific nucleic acid positions.

Self-Sustained Synthetic Reaction (3SR/NASBA): The self-sustained sequence replication reaction (3SR) is a transcription-based in vitro amplification system that can exponentially amplify RNA sequences at a uniform temperature. The amplified RNA can then be utilized for mutation detection. In this method, an oligonucleotide primer is used to add a phage RNA polymerase promoter to the 5' end of the sequence of interest. In a cocktail of enzymes and substrates that includes a second primer, reverse transcriptase, RNase H, RNA polymerase and ribo- and deoxyribonucleoside triphosphates, the target sequence undergoes repeated rounds of transcription, cDNA synthesis and second-strand synthesis to amplify the area of interest. The use of 3SR to detect mutations is kinetically limited to screening small segments of DNA (e.g., 200-300 base pairs).

Q-Beta (Qβ) Replicase: In this method, a probe which recognizes the sequence of interest is attached to the replicatable RNA template for Qβ replicase. A previously identified major problem with false positives resulting from the replication of unhybridized probes has been addressed through use of a sequence-specific ligation step. However, available thermostable DNA ligases are not effective on this RNA substrate, so the ligation must be performed by T4 DNA ligase at low temperatures (37 degrees C.). This prevents the use of high temperature as a means of achieving specificity as in the LCR, the ligation event can be used to detect a mutation at the junction site, but not elsewhere.

A successful diagnostic method must be very specific. A straight-forward method of controlling the specificity of nucleic acid hybridization is by controlling the temperature of the reaction. While the 3SR/NASBA, and Qβ systems are all able to generate a large quantity of signal, one or more of the enzymes involved in each cannot be used at high temperature (i.e., >55 degrees C.). Therefore the reaction temperatures cannot be raised to prevent non-specific hybridization of the probes. If probes are shortened in order to make them melt more easily at low temperatures, the likelihood of having more than one perfect match in a complex genome increases. For these reasons, PCR and LCR currently dominate the research field in detection technologies.

The basis of the amplification procedure in the PCR and LCR is the fact that the products of one cycle become usable templates in all subsequent cycles, consequently doubling the population with each cycle. The final yield of any such doubling system can be expressed as: $(1+X)^n = y$, where "X" is the mean efficiency (percent copied in each cycle), "n" is the number of cycles, and "y" is the overall efficiency, or yield of the reaction. If every copy of a target DNA is utilized as a template in every cycle of a polymerase chain reaction, then the mean efficiency is 100%. If 20 cycles of PCR are performed, then the yield will be $2^{20}$, or 1,048,576 copies of the starting material. If the reaction conditions reduce the mean efficiency to 85%, then the yield in those 20 cycles will be only $1.85^{20}$, or 220,513 copies of the starting material. In other words, a PCR running at 85% efficiency will yield only 21% as much final product, compared to a reaction running at 100% efficiency. A reaction that is reduced to 50% mean efficiency will yield less than 1% of the possible product.

In practice, routine polymerase chain reactions rarely achieve the theoretical maximum yield, and PCRs are usually run for more than 20 cycles to compensate for the lower yield. At 50% mean efficiency, it would take 34 cycles to achieve the million-fold amplification theoretically possible in 20, and at lower efficiencies, the number of cycles required becomes prohibitive. In addition, any background products that amplify with a better mean efficiency than the intended target will become the dominant products.

Also, many variables can influence the mean efficiency of PCR, including target DNA length and secondary structure, primer length and design, primer and dNTP concentrations, and buffer composition, to name but a few. Contamination of the reaction with exogenous DNA (e.g., DNA spilled onto lab surfaces) or cross-contamination is also a major consideration. Reaction conditions must be carefully optimized for each different primer pair and target sequence, and the process can take days, even for an experienced investigator. The laboriousness of this process, including numerous technical considerations and other factors, presents a significant drawback to using PCR in the clinical setting. Indeed, PCR has yet to penetrate the clinical market in a significant way. The same concerns arise with LCR, as LCR must also be optimized to use different oligonucleotide sequences for each target sequence. In addition, both methods require expensive equipment, capable of precise temperature cycling.

Many applications of nucleic acid detection technologies, such as in studies of allelic variation, involve not only detection of a specific sequence in a complex background, but also the discrimination between sequences with few, or single, nucleotide differences. One method of the detection of allele-specific variants by PCR is based upon the fact that it is difficult for Taq polymerase to synthesize a DNA strand when there is a mismatch between the template strand and the 3' end of the primer. An allele-specific variant may be detected by the use of a primer that is perfectly matched with only one of the possible alleles; the mismatch to the other allele acts to prevent the extension of the primer, thereby preventing the amplification of that sequence. This method has a substantial limitation in that the base composition of the mismatch influences the ability to prevent extension across the mismatch, and certain mismatches do not prevent extension or have only a minimal effect.

A similar 3'-mismatch strategy is used with greater effect to prevent ligation in the LCR. Any mismatch effectively blocks the action of the thermostable ligase, but LCR still has the drawback of target-independent background ligation products initiating the amplification. Moreover, the combination of PCR with subsequent LCR to identify the nucleotides at individual positions is also a clearly cumbersome proposition for the clinical laboratory.

The direct detection method according to various preferred embodiments of the present invention may be, for example a cycling probe reaction (CPR) or a branched DNA analysis.

When a sufficient amount of a nucleic acid to be detected is available, there are advantages to detecting that sequence directly, instead of making more copies of that target, (e.g., as in PCR and LCR). Most notably, a method that does not amplify the signal exponentially is more amenable to quantitative analysis. Even if the signal is enhanced by attaching multiple dyes to a single oligonucleotide, the correlation between the final signal intensity and amount of target is direct. Such a system has an additional advantage that the products of the reaction will not themselves promote further reaction, so contamination of lab surfaces by the products is not as much of a concern. Recently devised techniques have sought to eliminate the use of radioactivity and/or improve the sensitivity in automatable formats. Two examples are the "Cycling Probe Reaction" (CPR), and "Branched DNA" (bDNA).

Cycling probe reaction (CPR): The cycling probe reaction (CPR), uses a long chimeric oligonucleotide in which a central portion is made of RNA while the two termini are made of DNA. Hybridization of the probe to a target DNA and exposure to a thermostable RNase H causes the RNA portion to be digested. This destabilizes the remaining DNA portions of the duplex, releasing the remainder of the probe from the target DNA and allowing another probe molecule to repeat the process. The signal, in the form of cleaved probe molecules, accumulates at a linear rate. While the repeating process increases the signal, the RNA portion of the oligonucleotide is vulnerable to RNases that may carried through sample preparation.

Branched DNA: Branched DNA (bDNA), involves oligonucleotides with branched structures that allow each individual oligonucleotide to carry 35 to 40 labels (e.g., alkaline phosphatase enzymes). While this enhances the signal from a hybridization event, signal from non-specific binding is similarly increased.

The detection of at least one sequence change according to various preferred embodiments of the present invention may be accomplished by, for example restriction fragment length polymorphism (RFLP analysis), allele specific oligonucleotide (ASO) analysis, Denaturing/Temperature Gradient Gel Electrophoresis (DGGE/TGGE), Single-Strand Conformation Polymorphism (SSCP) analysis or Dideoxy fingerprinting (ddF).

The demand for tests which allow the detection of specific nucleic acid sequences and sequence changes is growing rapidly in clinical diagnostics. As nucleic acid sequence data for genes from humans and pathogenic organisms accumulates, the demand for fast, cost-effective, and easy-to-use tests for as yet mutations within specific sequences is rapidly increasing.

A handful of methods have been devised to scan nucleic acid segments for mutations. One option is to determine the entire gene sequence of each test sample (e.g., a bacterial isolate). For sequences under approximately 600 nucleotides, this may be accomplished using amplified material (e.g., PCR reaction products). This avoids the time and expense associated with cloning the segment of interest. However, specialized equipment and highly trained personnel are required, and the method is too labor-intense and expensive to be practical and effective in the clinical setting.

In view of the difficulties associated with sequencing, a given segment of nucleic acid may be characterized on several other levels. At the lowest resolution, the size of the molecule can be determined by electrophoresis by comparison to a known standard run on the same gel. A more detailed picture of the molecule may be achieved by cleavage with combinations of restriction enzymes prior to electrophoresis, to allow construction of an ordered map. The presence of specific sequences within the fragment can be detected by hybridization of a labeled probe, or the precise nucleotide sequence can be determined by partial chemical degradation or by primer extension in the presence of chain-terminating nucleotide analogs.

Restriction fragment length polymorphism (RFLP): For detection of single-base differences between like sequences, the requirements of the analysis are often at the highest level of resolution. For cases in which the position of the nucleotide in question is known in advance, several methods have been developed for examining single base changes without direct sequencing. For example, if a mutation of interest happens to fall within a restriction recognition sequence, a change in the pattern of digestion can be used as a diagnostic tool (e.g., restriction fragment length polymorphism [RFLP] analysis).

Single point mutations have been also detected by the creation or destruction of RFLPs. Mutations are detected and localized by the presence and size of the RNA fragments generated by cleavage at the mismatches. Single nucleotide mismatches in DNA heteroduplexes are also recognized and cleaved by some chemicals, providing an alternative strategy to detect single base substitutions, generically named the "Mismatch Chemical Cleavage" (MCC). However, this method requires the use of osmium tetroxide and piperidine, two highly noxious chemicals which are not suited for use in a clinical laboratory.

RFLP analysis suffers from low sensitivity and requires a large amount of sample. When RFLP analysis is used for the detection of point mutations, it is, by its nature, limited to the detection of only those single base changes which fall within a restriction sequence of a known restriction endonuclease. Moreover, the majority of the available enzymes have 4 to 6 base-pair recognition sequences, and cleave too frequently for many large-scale DNA manipulations. Thus, it is applicable only in a small fraction of cases, as most mutations do not fall within such sites.

A handful of rare-cutting restriction enzymes with 8 base-pair specificities have been isolated and these are widely used in genetic mapping, but these enzymes are few in number, are limited to the recognition of G+C-rich sequences, and cleave at sites that tend to be highly clustered. Recently, endonucleases encoded by group I introns have been discovered that might have greater than 12 base-pair specificity, but again, these are few in number.

Allele specific oligonucleotide (ASO): If the change is not in a recognition sequence, then allele-specific oligonucleotides (ASOs), can be designed to hybridize in proximity to the mutated nucleotide, such that a primer extension or ligation event can bused as the indicator of a match or a mismatch. Hybridization with radioactively labeled allelic specific oligonucleotides (ASO) also has been applied to the detection of specific point mutations. The method is based on the differences in the melting temperature of short DNA fragments differing by a single nucleotide. Stringent hybridization and washing conditions can differentiate between mutant and wild-type alleles. The ASO approach applied to PCR products also has been extensively utilized by various researchers to detect and characterize point mutations in ras genes and gsp/gip oncogenes. Because of the presence of various nucleotide changes in multiple positions, the ASO method requires the use of many oligonucleotides to cover all possible oncogenic mutations.

With either of the techniques described above (i.e., RFLP and ASO), the precise location of the suspected mutation must be known in advance of the test. That is to say, they are inapplicable when one needs to detect the presence of a mutation within a gene or sequence of interest.

Denaturing/Temperature Gradient Gel Electrophoresis (DGGE/TGGE): Two other methods rely on detecting changes in electrophoretic mobility in response to minor sequence changes. One of these methods, termed "Denaturing Gradient Gel Electrophoresis" (DGGE) is based on the observation that slightly different sequences will display different patterns of local melting when electrophoretically resolved on a gradient gel. In this manner, variants can be distinguished, as differences in melting properties of homo-duplexes versus heteroduplexes differing in a single nucleotide can detect the presence of mutations in the target sequences because of the corresponding changes in their electrophoretic mobilities. The fragments to be analyzed, usually PCR products, are "clamped" at one end by a long stretch of G-C base pairs (30-80) to allow complete denaturation of the sequence of interest without complete dissociation of the strands. The attachment of a GC "clamp" to the DNA fragments increases the fraction of mutations that can be recognized by DGGE. Attaching a GC clamp to one primer is critical to ensure that the amplified sequence has a low dissociation temperature. Modifications of the technique have been developed, using temperature gradients, and the method can be also applied to RNA:RNA duplexes.

Limitations on the utility of DGGE include the requirement that the denaturing conditions must be optimized for each type of DNA to be tested. Furthermore, the method requires specialized equipment to prepare the gels and maintain the needed high temperatures during electrophoresis. The expense associated with the synthesis of the clamping tail on one oligonucleotide for each sequence to be tested is also a major consideration. In addition, long running times are required for DGGE. The long running time of DGGE was shortened in a modification of DGGE called constant denaturant gel electrophoresis (CDGE). CDGE requires that gels be performed under different denaturant conditions in order to reach high efficiency for the detection of mutations.

A technique analogous to DGGE, termed temperature gradient gel electrophoresis (TGGE), uses a thermal gradient rather than a chemical denaturant gradient. TGGE requires the use of specialized equipment which can generate a temperature gradient perpendicularly oriented relative to the electrical field. TGGE can detect mutations in relatively small fragments of DNA therefore scanning of large gene segments requires the use of multiple PCR products prior to running the gel.

Single-Strand Conformation Polymorphism (SSCP): Another common method, called "Single-Strand Conformation Polymorphism" (SSCP) was developed by Hayashi, Sekya and colleagues and is based on the observation that single strands of nucleic acid can take on characteristic conformations in non-denaturing conditions, and these conformations influence electrophoretic mobility. The complementary strands assume sufficiently different structures that one strand may be resolved from the other. Changes in sequences within the fragment will also change the conformation, consequently altering the mobility and allowing this to be used as an assay for sequence variations.

The SSCP process involves denaturing a DNA segment (e.g., a PCR product) that is labeled on both strands, followed by slow electrophoretic separation on a non-denaturing polyacrylamide gel, so that intra-molecular interactions can form and not be disturbed during the run. This technique is extremely sensitive to variations in gel composition and temperature. A serious limitation of this method is the relative difficulty encountered in comparing data generated in different laboratories, under apparently similar conditions.

Dideoxy fingerprinting (ddF): The dideoxy fingerprinting (ddF) is another technique developed to scan genes for the presence of mutations. The ddF technique combines components of Sanger dideoxy sequencing with SSCP. A dideoxy sequencing reaction is performed using one dideoxy terminator and then the reaction products are electrophoresed on nondenaturing polyacrylamide gels to detect alterations in mobility of the termination segments as in SSCP analysis. While ddF is an improvement over SSCP in terms of increased sensitivity, ddF requires the use of expensive dideoxynucleotides and this technique is still limited to the analysis of fragments of the size suitable for SSCP (i.e., fragments of 200-300 bases for optimal detection of mutations).

In addition to the above limitations, all of these methods are limited as to the size of the nucleic acid fragment that can be analyzed. For the direct sequencing approach, sequences of greater than 600 base pairs require cloning, with the consequent delays and expense of either deletion sub-cloning or primer walking, in order to cover the entire fragment. SSCP and DGGE have even more severe size limitations. Because of reduced sensitivity to sequence changes, these methods are not considered suitable for larger fragments. Although SSCP is reportedly able to detect 90% of single-base substitutions within a 200 base-pair fragment, the detection drops to less than 50% for 400 base pair fragments. Similarly, the sensitivity of DGGE decreases as the length of the fragment reaches 500 base-pairs. The ddF technique, as a combination of direct sequencing and SSCP, is also limited by the relatively small size of the DNA that can be screened.

According to a presently preferred embodiment of the present invention the step of searching for any of the nucleic acid sequences described here, in tumor cells or in cells derived from a cancer patient is effected by any suitable technique, including, but not limited to, nucleic acid sequencing, polymerase chain reaction, ligase chain reaction, self-sustained synthetic reaction, Qβ-Replicase, cycling probe reaction, branched DNA, restriction fragment length polymorphism analysis, mismatch chemical cleavage, heteroduplex analysis, allele-specific oligonucleotides, denaturing gradient gel electrophoresis, constant denaturant gel electrophoresis, temperature gradient gel electrophoresis and dideoxy fingerprinting.

Detection may also optionally be performed with a chip or other such device. The nucleic acid sample which includes the candidate region to be analyzed is preferably isolated, amplified and labeled with a reporter group. This reporter group can be a fluorescent group such as phycoerythrin. The labeled nucleic acid is then incubated with the probes immobilized on the chip using a fluidics station. describe the fabrication of fluidics devices and particularly microcapillary devices, in silicon and glass substrates.

Once the reaction is completed, the chip is inserted into a scanner and patterns of hybridization are detected. The hybridization data is collected, as a signal emitted from the reporter groups already incorporated into the nucleic acid, which is now bound to the probes attached to the chip. Since the sequence and position of each probe immobilized on the chip is known, the identity of the nucleic acid hybridized to a given probe can be determined.

It will be appreciated that when utilized along with automated equipment, the above described detection methods can be used to screen multiple samples for a disease and/or pathological condition both rapidly and easily.

Amino Acid Sequences and Peptides

The terms "polypeptide," "peptide" and "protein" are used interchangeably herein to refer to a polymer of amino acid residues. The terms apply to amino acid polymers in which one or more amino acid residue is an analog or mimetic of a corresponding naturally occurring amino acid, as well as to naturally occurring amino acid polymers. Polypeptides can be modified, e.g., by the addition of carbohydrate residues to form glycoproteins. The terms "polypeptide," "peptide" and "protein" include glycoproteins, as well as non-glycoproteins.

Polypeptide products can be biochemically synthesized such as by employing standard solid phase techniques. Such methods include but are not limited to exclusive solid phase synthesis, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Solid phase polypeptide synthesis procedures are well known in the art and further described by John Morrow Stewart and Janis Dillaha Young, Solid Phase Peptide Syntheses (2nd Ed., Pierce Chemical Company, 1984).

Synthetic polypeptides can optionally be purified by preparative high performance liquid chromatography [Creighton T. (1983) Proteins, structures and molecular principles. WH Freeman and Co. N.Y.], after which their composition can be confirmed via amino acid sequencing.

In cases where large amounts of a polypeptide are desired, it can be generated using recombinant techniques such as described by Bitter et al., (1987) Methods in Enzymol. 153: 516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463.

The present invention also encompasses polypeptides encoded by the polynucleotide sequences of the present invention, as well as polypeptides according to the amino acid sequences described herein. The present invention also encompasses homologues of these polypeptides, such homologues can be at least 50%, at least 55%, at least 60%, at least 65%, at least 70%, at least 75%, at least 80%, at least 85%, at least 95% or more say 100% homologous to the amino acid sequences set forth below, as can be determined using BlastP software of the National Center of Biotechnology Information (NCBI) using default parameters, optionally and preferably including the following: filtering on (this option filters repetitive or low-complexity sequences from the query using the Seg (protein) program), scoring matrix is BLOSUM62 for proteins, word size is 3, E value is 10, gap costs are 11, 1 (initialization and extension), and number of alignments shown is 50. Nucleotide (nucleic acid) sequence homology/identity is preferably determined by using the BlastN software of the National Center of Biotechnology Information (NCBI) using default parameters, which preferably include using the DUST filter program, and also preferably include having an E value of 10, filtering low complexity sequences and a word size of 11. Finally, the present invention also encompasses fragments of the above described polypeptides and polypeptides having mutations, such as deletions, insertions or substitutions of one or more amino acids, either naturally occurring or artificially induced, either randomly or in a targeted fashion.

It will be appreciated that peptides identified according the present invention may be degradation products, synthetic peptides or recombinant peptides as well as peptidomimetics, typically, synthetic peptides and peptoids and semipeptoids which are peptide analogs, which may have, for example, modifications rendering the peptides more stable while in a body or more capable of penetrating into cells. Such modifications include, but are not limited to N terminus modification, C terminus modification, peptide bond modification, including, but not limited to, CH2-NH, CH2-S, CH2-S=O, O=C—NH, CH2-O, CH2-CH2, S=C—NH, CH=CH or CF=CH, backbone modifications, and residue modification. Methods for preparing peptidomimetic compounds are well known in the art and are specified. Further details in this respect are provided hereinunder.

Peptide bonds (—CO—NH—) within the peptide may be substituted, for example, by N-methylated bonds (—N(CH3)-CO—), ester bonds (—C(R)H—C—O—O—C(R)—N—), ketomethylen bonds (—CO—CH2-), α-aza bonds (—NH—N(R)—CO—), wherein R is any alkyl, e.g., methyl, carba bonds (—CH2-NH—), hydroxyethylene bonds (—CH(OH)—CH2-), thioamide bonds (—CS—NH—), olefinic double bonds (—CH=CH—), retro amide bonds (—NH—CO—), peptide derivatives (—N(R)—CH2-CO—), wherein R is the "normal" side chain, naturally presented on the carbon atom.

These modifications can occur at any of the bonds along the peptide chain and even at several (2-3) at the same time.

Natural aromatic amino acids, Trp, Tyr and Phe, may be substituted for synthetic non-natural acid such as Phenylglycine, TIC, naphthylelanine (Nol), ring-methylated derivatives of Phe, halogenated derivatives of Phe or o-methyl-Tyr.

In addition to the above, the peptides of the present invention may also include one or more modified amino acids or one or more non-amino acid monomers (e.g. fatty acids, complex carbohydrates etc).

As used herein in the specification and in the claims section below the term "amino acid" or "amino acids" is understood to include the 20 naturally occurring amino acids; those amino acids often modified post-translationally in vivo, including, for example, hydroxyproline, phosphoserine and phosphothreonine; and other unusual amino acids including, but not limited to, 2-aminoadipic acid, hydroxylysine, isodesmosine, nor-valine, nor-leucine and ornithine. Furthermore, the term "amino acid" includes both D- and L-amino acids.

Table 1 non-conventional or modified amino acids which can be used with the present invention.

TABLE 1

| Non-conventional amino acid | Code |
|---|---|
| α-aminobutyric acid | Abu |
| α-amino-α-methylbutyrate | Mgabu |
| aminocyclopropane-Carboxylate | Cpro |
| aminoisobutyric acid | Aib |
| aminonorbornyl-Carboxylate | Norb |
| Cyclohexylalanine | Chexa |
| Cyclopentylalanine | Cpen |
| D-alanine | Dal |
| D-arginine | Darg |
| D-aspartic acid | Dasp |
| D-cysteine | Dcys |
| D-glutamine | Dgln |
| D-glutamic acid | Dglu |
| D-histidine | Dhis |
| D-isoleucine | Dile |
| D-leucine | Dleu |
| D-lysine | Dlys |
| D-methionine | Dmet |
| D-ornithine | Dorn |
| D-phenylalanine | Dphe |
| D-proline | Dpro |
| D-serine | Dser |
| D-threonine | Dthr |
| D-tryptophan | Dtrp |
| D-tyrosine | Dtyr |
| D-valine | Dval |

TABLE 1-continued

| Non-conventional amino acid | Code |
|---|---|
| D-α-methylalanine | Dmala |
| D-α-methylarginine | Dmarg |
| D-α-methylasparagine | Dmasn |
| D-α-methylaspartate | Dmasp |
| D-α-methylcysteine | Dmcys |
| D-α-methylglutamine | Dmgln |
| D-α-methylhistidine | Dmhis |
| D-α-methylisoleucine | Dmile |
| D-α-methylleucine | Dmleu |
| D-α-methyllysine | Dmlys |
| D-α-methylmethionine | Dmmet |
| D-α-methylornithine | Dmorn |
| D-α-methylphenylalanine | Dmphe |
| D-α-methylproline | Dmpro |
| D-α-methylserine | Dmser |
| D-α-methylthreonine | Dmthr |
| D-α-methyltryptophan | Dmtrp |
| D-α-methyltyrosine | Dmty |
| D-α-methylvaline | Dmval |
| D-α-methylalnine | Dnmala |
| D-α-methylarginine | Dnmarg |
| D-α-methylasparagine | Dnmasn |
| D-α-methylasparatate | Dnmasp |
| D-α-methylcysteine | Dnmcys |
| D-N-methylleucine | Dnmleu |
| D-N-methyllysine | Dnmlys |
| N-methylcyclohexylalanine | Nmchexa |
| D-N-methylornithine | Dnmorn |
| N-methylglycine | Nala |
| N-methylaminoisobutyrate | Nmaib |
| N-(1-methylpropyl)glycine | Nile |
| N-(2-methylpropyl)glycine | Nleu |
| D-N-methyltryptophan | Dnmtrp |
| D-N-methyltyrosine | Dnmtyr |
| D-N-methylvaline | Dnmval |
| γ-aminobutyric acid | Gabu |
| L-t-butylglycine | Tbug |
| L-ethylglycine | Etg |
| L-homophenylalanine | Hphe |
| L-α-methylarginine | Marg |
| L-α-methylaspartate | Masp |
| L-α-methylcysteine | Mcys |
| L-α-methylglutamine | Mgln |
| L-α-methylhistidine | Mhis |
| L-α-methylisoleucine | Mile |
| D-N-methylglutamine | Dnmgln |
| D-N-methylglutamate | Dnmglu |
| D-N-methylhistidine | Dnmhis |
| D-N-methylisoleucine | Dnmile |
| D-N-methylleucine | Dnmleu |
| D-N-methyllysine | Dnmlys |
| N-methylcyclohexylalanine | Nmchexa |
| D-N-methylornithine | Dnmorn |
| N-methylglycine | Nala |
| N-methylaminoisobutyrate | Nmaib |
| N-(1-methylpropyl)glycine | Nile |
| N-(2-methylpropyl)glycine | Nleu |
| D-N-methyltryptophan | Dnmtrp |
| D-N-methyltyrosine | Dnmtyr |
| D-N-methylvaline | Dnmval |
| γ-aminobutyric acid | Gabu |
| L-t-butylglycine | Tbug |
| L-ethylglycine | Etg |
| L-homophenylalanine | Hphe |
| L-α-methylarginine | Marg |
| L-α-methylaspartate | Masp |
| L-α-methylcysteine | Mcys |
| L-α-methylglutamine | Mgln |
| L-α-methylhistidine | Mhis |
| L-α-methylisoleucine | Mile |
| L-α-methylleucine | Mleu |
| L-α-methylmethionine | Mmet |
| L-α-methylnorvaline | Mnva |
| L-α-methylphenylalanine | Mphe |
| L-α-methylserine | mser |
| L-α-methylvaline | Mtrp |

| Non-conventional amino acid | Code |
|---|---|
| L-α-methylleucine | Mval |
|  | Nnbhm |
| N-(N-(2,2-diphenylethyl) carbamylmethyl-glycine | Nnbhm |
| 1-carboxy-1-(2,2-diphenyl ethylamino)cyclopropane | Nmbc |
| L-N-methylalanine | Nmala |
| L-N-methylarginine | Nmarg |
| L-N-methylasparagine | Nmasn |
| L-N-methylaspartic acid | Nmasp |
| L-N-methylcysteine | Nmcys |
| L-N-methylglutamine | Nmgln |
| L-N-methylglutamic acid | Nmglu |
| L-N-methylhistidine | Nmhis |
| L-N-methylisolleucine | Nmile |
| L-N-methylleucine | Nmleu |
| L-N-methyllysine | Nmlys |
| L-N-methylmethionine | Nmmet |
| L-N-methylnorleucine | Nmnle |
| L-N-methylnorvaline | Nmnva |
| L-N-methylornithine | Nmorn |
| L-N-methylphenylalanine | Nmphe |
| L-N-methylproline | Nmpro |
| L-N-methylserine | Nmser |
| L-N-methylthreonine | Nmthr |
| L-N-methyltryptophan | Nmtrp |
| L-N-methyltyrosine | Nmtyr |
| L-N-methylvaline | Nmval |
| L-N-methylethylglycine | Nmetg |
| L-N-methyl-t-butylglycine | Nmtbug |
| L-norleucine | Nle |
| L-norvaline | Nva |
| α-methyl-aminoisobutyrate | Maib |
| α-methyl-γ-aminobutyrate | Mgabu |
| α-methylcyclohexylalanine | Mchexa |
| α-methylcyclopentylalanine | Mcpen |
| α-methyl-α-napthylalanine | Manap |
| α-methylpenicillamine | Mpen |
| N-(4-aminobutyl)glycine | Nglu |
| N-(2-aminoethyl)glycine | Naeg |
| N-(3-aminopropyl)glycine | Norn |
| N-amino-α-methylbutyrate | Nmaabu |
| α-napthylalanine | Anap |
| N-benzylglycine | Nphe |
| N-(2-carbamylethyl)glycine | Ngln |
| N-(carbamylmethyl)glycine | Nasn |
| N-(2-carboxyethyl)glycine | Nglu |
| N-(carboxymethyl)glycine | Nasp |
| N-cyclobutylglycine | Ncbut |
| N-cycloheptylglycine | Nchep |
| N-cyclohexylglycine | Nchex |
| N-cyclodecylglycine | Ncdec |
| N-cyclododeclglycine | Ncdod |
| N-cyclooctylglycine | Ncoct |
| N-cyclopropylglycine | Ncpro |
| N-cycloundecylglycine | Ncund |
| N-(2,2-diphenylethyl)glycine | Nbhm |
| N-(3,3-diphenylpropyl)glycine | Nbhe |
| N-(3-indolylyethyl)glycine | Nhtrp |
| N-methyl-γ-aminobutyrate | Nmgabu |
| D-N-methylmethionine | Dnmmet |
| N-methylcyclopentylalanine | Nmcpen |
| D-N-methylphenylalanine | Dnmphe |
| D-N-methylproline | Dnmpro |
| D-N-methylserine | Dnmser |
| D-N-methylserine | Dnmser |
| D-N-methylthreonine | Dnmthr |
| N-(1-methylethyl)glycine | Nva |
| N-methyla-napthylalanine | Nmanap |
| N-methylpenicillamine | Nmpen |
| N-(p-hydroxyphenyl)glycine | Nhtyr |
| N-(thiomethyl)glycine | Ncys |
| penicillamine | Pen |
| L-α-methylalanine | Mala |
| L-α-methylasparagine | Masn |
| L-α-methyl-t-butylglycine | Mtbug |
| L-methylethylglycine | Metg |

TABLE 1-continued

| Non-conventional amino acid | Code |
| --- | --- |
| L-α-methylglutamate | Mglu |
| L-α-methylhomo phenylalanine | Mhphe |
| N-(2-methylthioethyl)glycine | Nmet |
| N-(3-guanidinopropyl)glycine | Narg |
| N-(1-hydroxyethyl)glycine | Nthr |
| N-(hydroxyethyl)glycine | Nser |
| N-(imidazolylethyl)glycine | Nhis |
| N-(3-indolylethyl)glycine | Nhtrp |
| N-methyl-γ-aminobutyrate | Nmgabu |
| D-N-methylmethionine | Dnmmet |
| N-methylcyclopentylalanine | Nmcpen |
| D-N-methylphenylalanine | Dnmphe |
| D-N-methylproline | Dnmpro |
| D-N-methylserine | Dnmser |
| D-N-methylthreonine | Dnmthr |
| N-(1-methylethyl)glycine | Nval |
| N-methyla-napthylalanine | Nmanap |
| N-methylpenicillamine | Nmpen |
| N-(p-hydroxyphenyl)glycine | Nhtyr |
| N-(thiomethyl)glycine | Ncys |
| penicillamine | Pen |
| L-α-methylalanine | Mala |
| L-α-methylasparagine | Masn |
| L-α-methyl-t-butylglycine | Mtbug |
| L-methylethylglycine | Metg |
| L-α-methylglutamate | Mglu |
| L-α-methylhomophenylalanine | Mhphe |
| N-(2-methylthioethyl)glycine | Nmet |
| L-α-methyllysine | Mlys |
| L-α-methylnorleucine | Mnle |
| L-α-methylornithine | Morn |
| L-α-methylproline | Mpro |
| L-α-methylthreonine | Mthr |
| L-α-methyltyrosine | Mtyr |
| L-N-methylhomophenylalanine | Nmhphe |
| N-(N-(3,3-diphenylpropyl) carbamylmethyl(1)glycine | Nnbhe |

Since the peptides of the present invention are preferably utilized in diagnostics which require the peptides to be in soluble form, the peptides of the present invention preferably include one or more non-natural or natural polar amino acids, including but not limited to serine and threonine which are capable of increasing peptide solubility due to their hydroxyl-containing side chain.

The peptides of the present invention are preferably utilized in a linear form, although it will be appreciated that in cases where cyclicization does not severely interfere with peptide characteristics, cyclic forms of the peptide can also be utilized.

The peptides of present invention can be biochemically synthesized such as by using standard solid phase techniques. These methods include exclusive solid phase synthesis well known in the art, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Synthetic peptides can be purified by preparative high performance liquid chromatography and the composition of which can be confirmed via amino acid sequencing.

In cases where large amounts of the peptides of the present invention are desired, the peptides of the present invention can be generated using recombinant techniques such as described by Bitter et al., (1987) Methods in Enzymol. 153: 516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463 and also as described above.

Antibodies

"Antibody" refers to a polypeptide ligand that is preferably substantially encoded by an immunoglobulin gene or immunoglobulin genes, or fragments thereof, which specifically binds and recognizes an epitope (e.g., an antigen). The recognized immunoglobulin genes include the kappa and lambda light chain constant region genes, the alpha, gamma, delta, epsilon and mu heavy chain constant region genes, and the myriad-immunoglobulin variable region genes. Antibodies exist, e.g., as intact immunoglobulins or as a number of well characterized fragments produced by digestion with various peptidases. This includes, e.g., Fab' and F(ab)'$_2$ fragments. The term "antibody," as used herein, also includes antibody fragments either produced by the modification of whole antibodies or those synthesized de novo using recombinant DNA methodologies. It also includes polyclonal antibodies, monoclonal antibodies, chimeric antibodies, humanized antibodies, or single chain antibodies. "Fc" portion of an antibody refers to that portion of an immunoglobulin heavy chain that comprises one or more heavy chain constant region domains, CH1, CH2 and CH3, but does not include the heavy chain variable region.

The functional fragments of antibodies, such as Fab, F(ab')2, and Fv that are capable of binding to macrophages, are described as follows: (1) Fab, the fragment which contains a monovalent antigen-binding fragment of an antibody molecule, can be produced by digestion of whole antibody with the enzyme papain to yield an intact light chain and a portion of one heavy chain; (2) Fab', the fragment of an antibody molecule that can be obtained by treating whole antibody with pepsin, followed by reduction, to yield an intact light chain and a portion of the heavy chain; two Fab' fragments are obtained per antibody molecule; (3) (Fab')2, the fragment of the antibody that can be obtained by treating whole antibody with the enzyme pepsin without subsequent reduction; F(ab')2 is a dimer of two Fab' fragments held together by two disulfide bonds; (4) Fv, defined as a genetically engineered fragment containing the variable region of the light chain and the variable region of the heavy chain expressed as two chains; and (5) Single chain antibody ("SCA"), a genetically engineered molecule containing the variable region of the light chain and the variable region of the heavy chain, linked by a suitable polypeptide linker as a genetically fused single chain molecule.

Methods of producing polyclonal and monoclonal antibodies as well as fragments thereof are well known in the art (See for example, Harlow and Lane, Antibodies: A Laboratory Manual, Cold Spring Harbor Laboratory, New York, 1988, incorporated herein by reference).

Antibody fragments according to the present invention can be prepared by proteolytic hydrolysis of the antibody or by expression in E. coli or mammalian cells (e.g. Chinese hamster ovary cell culture or other protein expression systems) of DNA encoding the fragment. Antibody fragments can be obtained by pepsin or papain digestion of whole antibodies by conventional methods. For example, antibody fragments can be produced by enzymatic cleavage of antibodies with pepsin to provide a 5S fragment denoted F(ab')2. This fragment can be further cleaved using a thiol reducing agent, and optionally a blocking group for the sulfhydryl groups resulting from cleavage of disulfide linkages, to produce 3.5 S Fab' monovalent fragments. Alternatively, an enzymatic cleavage using pepsin produces two monovalent Fab' fragments and an Fc fragment directly. These methods are described, for example, by Goldenberg, U.S. Pat. Nos. 4,036,945 and 4,331,647, and references contained therein, which patents are hereby incorporated by reference in their entirety. See also Porter, R. R. [Biochem. J. 73: 119-126 (1959)]. Other methods of cleaving antibodies, such as separation of heavy chains to form monovalent light-heavy chain fragments, further cleavage of fragments, or other enzymatic, chemical, or genetic techniques may also be used, so long as the fragments bind to the antigen that is recognized by the intact antibody.

Fv fragments comprise an association of VH and VL chains. This association may be noncovalent, as described in Inbar et al. [Proc. Nat'l Acad. Sci. USA 69:2659-62 (19720]. Alternatively, the variable chains can be linked by an intermolecular disulfide bond or cross-linked by chemicals such as glutaraldehyde. Preferably, the Fv fragments comprise VH and VL chains connected by a peptide linker. These single-chain antigen binding proteins (sFv) are prepared by constructing a structural gene comprising DNA sequences encoding the VH and VL domains connected by an oligonucleotide. The structural gene is inserted into an expression vector, which is subsequently introduced into a host cell such as E. coli. The recombinant host cells synthesize a single polypeptide chain with a linker peptide bridging the two V domains. Methods for producing sFvs are described, for example, by [Whitlow and Filpula, Methods 2: 97-105 (1991); Bird et al., Science 242:423-426 (1988); Pack et al., Bio/Technology 11:1271-77 (1993); and U.S. Pat. No. 4,946, 778, which is hereby incorporated by reference in its entirety.

Another form of an antibody fragment is a peptide coding for a single complementarity-determining region (CDR). CDR peptides ("minimal recognition units") can be obtained by constructing genes encoding the CDR of an antibody of interest. Such genes are prepared, for example, by using the polymerase chain reaction to synthesize the variable region from RNA of antibody-producing cells. See, for example, Larrick and Fry [Methods, 2: 106-10 (1991)].

Humanized forms of non-human (e.g., murine) antibodies are chimeric molecules of immunoglobulins, immunoglobulin chains or fragments thereof (such as Fv, Fab, Fab', F(ab') or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., Nature, 321: 522-525 (1986); Riechmann et al., Nature, 332:323-329 (1988); and Presta, Curr. Op. Struct. Biol., 2:593-596 (1992)].

Methods for humanizing non-human antibodies are well known in the art. Generally, a humanized antibody has one or more amino acid residues introduced into it from a source which is non-human. These non-human amino acid residues are often referred to as import residues, which are typically taken from an import variable domain. Humanization can be essentially performed following the method of Winter and co-workers [Jones et al., Nature, 321:522-525 (1986); Riechmann et al., Nature 332:323-327 (1988); Verhoeyen et al., Science, 239:1534-1536 (1988)], by substituting rodent CDRs or CDR sequences for the corresponding sequences of a human antibody. Accordingly, such humanized antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, J. Mol. Biol., 227:381 (1991); Marks et al., J. Mol. Biol., 222:581 (1991)]. The techniques of Cole et al. and Boemer et al. are also available for the preparation of human monoclonal antibodies (Cole et al., Monoclonal Antibodies and Cancer Therapy, Alan R. Liss, p. 77 (1985) and Boerner et al., J. Immunol., 147(1):86-95 (1991)]. Similarly, human antibodies can be made by introduction of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545, 807; 5,545,806; 5,569,825; 5,625,126; 5,633,425; 5,661,016, and in the following scientific publications: Marks et al., Bio/Technology 10: 779-783 (1992); Lonberg et al., Nature 368: 856-859 (1994); Morrison, Nature 368 812-13 (1994); Fishwild et al., Nature Biotechnology 14, 845-51 (1996); Neuberger, Nature Biotechnology 14: 826 (1996); and Lonberg and Huszar, Intern. Rev. Immunol. 13, 65-93 (1995).

Preferably, the antibody of this aspect of the present invention specifically binds at least one epitope of the polypeptide variants of the present invention. As used herein, the term "epitope" refers to any antigenic determinant on an antigen to which the paratope of an antibody binds.

Epitopic determinants usually consist of chemically active surface groupings of molecules such as amino acids or carbohydrate side chains and usually have specific three dimensional structural characteristics, as well as specific charge characteristics.

Optionally, a unique epitope may be created in a variant due to a change in one or more post-translational modifications, including but not limited to glycosylation and/or phosphorylation, as described below. Such a change may also cause a new epitope to be created, for example through removal of glycosylation at a particular site.

An epitope according to the present invention may also optionally comprise part or all of a unique sequence portion of a variant according to the present invention in combination with at least one other portion of the variant which is not contiguous to the unique sequence portion in the linear polypeptide itself, yet which are able to form an epitope in combination. One or more unique sequence portions may optionally combine with one or more other non-contiguous portions of the variant (including a portion which may have high homology to a portion of the known protein) to form an epitope.

Immunoassays

In another embodiment of the present invention, an immunoassay can be used to qualitatively or quantitatively detect and analyze markers in a sample. This method comprises: providing an antibody that specifically binds to a marker; contacting a sample with the antibody; and detecting the presence of a complex of the antibody bound to the marker in the sample.

To prepare an antibody that specifically binds to a marker, purified protein markers can be used. Antibodies that specifically bind to a protein marker can be prepared using any suitable methods known in the art.

After the antibody is provided, a marker can be detected and/or quantified using any of a number of well recognized immunological binding assays. Useful assays include, for example, an enzyme immune assay (EIA) such as enzyme-linked immunosorbent assay (ELISA), a radioimmune assay (RIA), a Western blot assay, or a slot blot assay see, e.g., U.S. Pat. Nos. 4,366,241; 4,376,110; 4,517,288; and 4,837,168). Generally, a sample obtained from a subject can be contacted with the antibody that specifically binds the marker.

Optionally, the antibody can be fixed to a solid support to facilitate washing and subsequent isolation of the complex, prior to contacting the antibody with a sample. Examples of solid supports include but are not limited to glass or plastic in the form of, e.g., a microtiter plate, a stick, a bead, or a microbead. Antibodies can also be attached to a solid support.

After incubating the sample with antibodies, the mixture is washed and the antibody-marker complex formed can be detected. This can be accomplished by incubating the washed mixture with a detection reagent. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

Throughout the assays, incubation and/or washing steps may be required after each combination of reagents. Incubation steps can vary from about 5 seconds to several hours, preferably from about 5 minutes to about 24 hours. However, the incubation time will depend upon the assay format, marker, volume of solution, concentrations and the like. Usually the assays will be carried out at ambient temperature, although they can be conducted over a range of temperatures, such as 10° C. to 40° C.

The immunoassay can be used to determine a test amount of a marker in a sample from a subject. First, a test amount of a marker in a sample can be detected using the immunoassay methods described above. If a marker is present in the sample, it will form an antibody-marker complex with an antibody that specifically binds the marker under suitable incubation conditions described above. The amount of an antibody-marker complex can optionally be determined by comparing to a standard. As noted above, the test amount of marker need not be measured in absolute units, as long as the unit of measurement can be compared to a control amount and/or signal.

Preferably used are antibodies which specifically interact with the polypeptides of the present invention and not with wild type proteins or other isoforms thereof, for example. Such antibodies are directed, for example, to the unique sequence portions of the polypeptide variants of the present invention, including but not limited to bridges, heads, tails and insertions described in greater detail below. Preferred embodiments of antibodies according to the present invention are described in greater detail with regard to the section entitled "Antibodies".

Radio-immunoassay (RIA): In one version, this method involves precipitation of the desired substrate and in the methods detailed hereinbelow, with a specific antibody and radiolabelled antibody binding protein (e.g., protein A labeled with I125) immobilized on a precipitable carrier such as agarose beads. The number of counts in the precipitated pellet is proportional to the amount of substrate.

In an alternate version of the RIA, a labeled substrate and an unlabelled antibody binding protein are employed. A sample containing an unknown amount of substrate is added in varying amounts. The decrease in precipitated counts from the labeled substrate is proportional to the amount of substrate in the added sample.

Enzyme linked immunosorbent assay (ELISA): This method involves fixation of a sample (e.g., fixed cells or a proteinaceous solution) containing a protein substrate to a surface such as a well of a microtiter plate. A substrate specific antibody coupled to an enzyme is applied and allowed to bind to the substrate. Presence of the antibody is then detected and quantitated by a calorimetric reaction employing the enzyme coupled to the antibody. Enzymes commonly employed in this method include horseradish peroxidase and alkaline phosphatase. If well calibrated and within the linear range of response, the amount of substrate present in the sample is proportional to the amount of color produced. A substrate standard is generally employed to improve quantitative accuracy.

Western blot: This method involves separation of a substrate from other protein by means of an acrylamide gel followed by transfer of the substrate to a membrane (e.g., nylon or PVDF). Presence of the substrate is then detected by antibodies specific to the substrate, which are in turn detected by antibody binding reagents. Antibody binding reagents may be, for example, protein A, or other antibodies. Antibody binding reagents may be radiolabelled or enzyme linked as described hereinabove. Detection may be by autoradiography, calorimetric reaction or chemiluminescence. This method allows both quantitation of an amount of substrate and determination of its identity by a relative position on the membrane which is indicative of a migration distance in the acrylamide gel during electrophoresis.

Immunohistochemical analysis: This method involves detection of a substrate in situ in fixed cells by substrate specific antibodies. The substrate specific antibodies may be enzyme linked or linked to fluorophores. Detection is by microscopy and subjective evaluation. If enzyme linked antibodies are employed, a colorimetric reaction may be required.

Fluorescence activated cell sorting (FACS): This method involves detection of a substrate in situ in cells by substrate specific antibodies. The substrate specific antibodies are linked to fluorophores. Detection is by means of a cell sorting machine which reads the wavelength of light emitted from each cell as it passes through a light beam. This method may employ two or more antibodies simultaneously.

Radio-Imaging Methods

These methods include but are not limited to, positron emission tomography (PET) single photon emission computed tomography (SPECT). Both of these techniques are non-invasive, and can be used to detect and/or measure a wide variety of tissue events and/or functions, such as detecting cancerous cells for example. Unlike PET, SPECT can optionally be used with two labels simultaneously. SPECT has some other advantages as well, for example with regard to cost and the types of labels that can be used. For example, U.S. Pat. No. 6,696,686 describes the use of SPECT for detection of breast cancer, and is hereby incorporated by reference as if fully set forth herein.

Display Libraries

According to still another aspect of the present invention there is provided a display library comprising a plurality of display vehicles (such as phages, viruses or bacteria) each displaying at least 6, at least 7, at least 8, at least 9, at least 10, 10-15, 12-17, 15-20, 15-30 or 20-50 consecutive amino acids derived from the polypeptide sequences of the present invention.

Methods of constructing such display libraries are well known in the art. Such methods are described in, for example, Young A C, et al., "The three-dimensional structures of a polysaccharide binding antibody to *Cryptococcus neoformans* and its complex with a peptide from a phage display library: implications for the identification of peptide mimotopes" J Mol Biol 1997 Dec. 12; 274(4):622-34; Giebel L B et al. "Screening of cyclic peptide phage libraries identifies ligands that bind streptavidin with high affinities" Biochemistry 1995 Nov. 28; 34(47):15430-5; Davies E L et al., "Selection of specific phage-display antibodies using libraries derived from chicken immunoglobulin genes" J Immunol Methods 1995 Oct. 12; 186(1):125-35; Jones C RT al. "Current trends in molecular recognition and bioseparation" J Chromatogr A 1995 Jul. 14; 707(1):3-22; Deng S J et al. "Basis for selection of improved carbohydrate-binding single-chain antibodies from synthetic gene libraries" Proc Natl Acad Sci USA 1995 May 23; 92(11):4992-6; and Deng S J et al. "Selection of antibody single-chain variable fragments with improved carbohydrate binding by phage display" J Biol Chem 1994 Apr. 1; 269(13):9533-8, which are incorporated herein by reference.

The following sections relate to Candidate Marker Examples (first section) and to Experimental Data for these Marker Examples (second section). It should be noted that Table numbering is restarted within each section.

Candidate Marker Examples Section

This Section relates to Examples of sequences according to the present invention, including illustrative methods of selection thereof.

Description of the methodology undertaken to uncover the biomolecular sequences of the present invention Human ESTs and cDNAs were obtained from GenBank versions 136 (Jun. 15, 2003 ncbi.nih.gov/genbank/release.notes/gb136.release.notes); NCBI genome assembly of April 2003; RefSeq sequences from June 2003; Genbank version 139 (December 2003); Human Genome from NCBI (Build 34) (from October 2003); and RefSeq sequences from December 2003; and from the LifeSeq library of Incyte Corporation (ESTs only; Wilmington, Del., USA). With regard to GenBank sequences, the human EST sequences from the EST (GBEST) section and the human mRNA sequences from the primate (GBPRI) section were used; also the human nucleotide RefSeq mRNA sequences were used (see for example ncbi.nlm.nih.gov/Genbank/GenbankOverview.html and for a reference to the EST section, see ncbi.nlm.nih.gov/dbEST/; a general reference to dbEST, the EST database in GenBank, may be found in Boguski et al, Nat Genet. 1993 August; 4(4):332-3; all of which are hereby incorporated by reference as if fully set forth herein).

Novel splice variants were predicted using the LEADS clustering and assembly system as described in Sorek, R., Ast, G. & Graur, D. Alu-containing exons are alternatively spliced. Genome Res 12, 1060-7 (2002); U.S. Pat. No. 6,625,545; and U.S. patent application Ser. No. 10/426,002, published as US20040101876 on May 27, 2004; all of which are hereby incorporated by reference as if fully set forth herein. Briefly, the software cleans the expressed sequences from repeats, vectors and immunoglobulins. It then aligns the expressed sequences to the genome taking alternatively splicing into account and clusters overlapping expressed sequences into "clusters" that represent genes or partial genes.

These were annotated using the GeneCarta (Compugen, Tel-Aviv, Israel) platform. The GeneCarta platform includes a rich pool of annotations, sequence information (particularly of spliced sequences), chromosomal information, alignments, and additional information such as SNPs, gene ontology terms, expression profiles, functional analyses, detailed domain structures, known and predicted proteins and detailed homology reports.

A brief explanation is provided with regard to the method of selecting the candidates. However, it should noted that this explanation is provided for descriptive purposes only, and is not intended to be limiting in any way. The potential markers were identified by a computational process that was designed to find genes and/or their splice variants that are over-expressed in tumor tissues, by using databases of expressed sequences. Various parameters related to the information in the EST libraries, determined according to a manual classification process, were used to assist in locating genes and/or splice variants thereof that are over-expressed in below. The cancer biomarkers selection engine and the following wet validation stages are schematically summarized in FIG. 1.

EXAMPLE 1

Identification Of differentially Expressed Gene Products

Algorithm

In order to distinguish between differentially expressed gene products and constitutively expressed genes (i.e., house keeping genes) an algorithm based on an analysis of frequencies was configured. A specific algorithm for identification of transcripts over expressed in cancer is described hereinbelow.

Dry Analysis

Library annotation—EST libraries are manually classified according to:
  (i) Tissue origin
  (ii) Biological source—Examples of frequently used biological sources for construction of EST libraries include cancer cell-lines; normal tissues; cancer tissues; fetal tissues; and others such as normal cell lines and pools of normal cell-lines, cancer cell-lines and combinations thereof. A specific description of abbreviations used below with regard to these tissues/cell lines etc is given above.
  (iii) Protocol of library construction—various methods are known in the art for library construction including normalized library construction; non-normalized library construction; subtracted libraries; ORESTES and others. It will be appreciated that at times the protocol of library construction is not indicated.

The following rules were followed:

EST libraries originating from identical biological samples are considered as a single library.

EST libraries which included above-average levels of contamination, such as DNA contamination for example, were eliminated. The presence of such contamination was determined as follows. For each library, the number of unspliced ESTs that are not fully contained within other spliced sequences was counted. If the percentage of such sequences (as compared to all other sequences) was at least 4 standard deviations above the average for all libraries being analyzed, this library was tagged as being contaminated and was eliminated from further consideration in the below analysis (see also Sorek, R. & Safer, H. M. A novel algorithm for computational identification of contaminated EST libraries. Nucleic Acids Res 31, 1067-74 (2003) for further details).

Clusters (genes) having at least five sequences including at least two sequences from the tissue of interest were analyzed. Splice variants were identified by using the LEADS software package as described above.

EXAMPLE 2

Identification of Genes Over Expressed in Cancer

Two different scoring algorithms were developed.

Libraries score—candidate sequences which are supported by a number of cancer libraries, are more likely to serve as specific and effective diagnostic markers.

The basic algorithm—for each cluster the number of cancer and normal libraries contributing sequences to the cluster was counted. Fisher exact test was used to check if cancer libraries are significantly over-represented in the cluster as compared to the total number of cancer and normal libraries.

Library counting: Small libraries (e.g., less than 1000 sequences) were excluded from consideration unless they participate in the cluster. For this reason, the total number of libraries is actually adjusted for each cluster.

Clones no. score—Generally, when the number of ESTs is much higher in the cancer libraries relative to the normal libraries it might indicate actual over-expression.

The algorithm—

Clone counting: For counting EST clones each library protocol class was given a weight based on our belief of how much the protocol reflects actual expression levels:

(i) non-normalized: 1
(ii) normalized: 0.2
(iii) all other classes: 0.1

Clones number score—The total weighted number of EST clones from cancer libraries was compared to the EST clones from normal libraries. To avoid cases where one library contributes to the majority of the score, the contribution of the library that gives most clones for a given cluster was limited to 2 clones.

The score was computed as $$\frac{\frac{c+1}{C}}{\frac{n+1}{N}}$$

where:
c—weighted number of "cancer" clones in the cluster.
C—weighted number of clones in all "cancer" libraries.
n—weighted number of "normal" clones in the cluster.
N—weighted number of clones in all "normal" libraries.

Clones number score significance—Fisher exact test was used to check if EST clones from cancer libraries are significantly over-represented in the cluster as compared to the total number of EST clones from cancer and normal libraries.

Two search approaches were used to find either general cancer-specific candidates or tumor specific candidates.

Libraries/sequences originating from tumor tissues are counted as well as libraries originating from cancer cell-lines ("normal" cell-lines were ignored).

Only libraries/sequences originating from tumor tissues are counted

EXAMPLE 3

Identification of Tissue Specific Genes

For detection of tissue specific clusters, tissue libraries/sequences were compared to the total number of libraries/sequences in cluster. Similar statistical tools to those described in above were employed to identify tissue specific genes. Tissue abbreviations are the same as for cancerous tissues, but are indicated with the header "normal tissue".

The algorithm—for each tested tissue T and for each tested cluster the following were examined:

1. Each cluster includes at least 2 libraries from the tissue T. At least 3 clones (weighed—as described above) from tissue T in the cluster; and
2. Clones from the tissue T are at least 40% from all the clones participating in the tested cluster Fisher exact test P-values were computed both for library and weighted clone counts to check that the counts are statistically significant.

EXAMPLE 4

Identification of Splice Variants Over Expressed in Cancer of Clusters which are not Over Expressed in Cancer Cancer-specific splice variants containing a unique region were identified.

Identification of unique sequence regions in splice variants

A Region is defined as a group of adjacent exons that always appear or do not appear together in each splice variant.

A "segment" (sometimes referred also as "seg" or "node") is defined as the shortest contiguous transcribed region without known splicing inside.

Only reliable ESTs were considered for region and segment analysis. An EST was defined as unreliable if:

(i) Unspliced;
(ii) Not covered by RNA;
(iii) Not covered by spliced ESTs; and
(iv) Alignment to the genome ends in proximity of long poly-A stretch or starts in proximity of long poly-T stretch.

Only reliable regions were selected for further scoring. Unique sequence regions were considered reliable if:

(i) Aligned to the genome; and
(ii) Regions supported by more than 2 ESTs.

The algorithm

Each unique sequence region divides the set of transcripts into 2 groups:

(i) Transcripts containing this region (group TA).
(ii) Transcripts not containing this region (group TB).

The set of EST clones of every cluster is divided into 3 groups:

(i) Supporting (originating from) transcripts of group TA (SI).
(ii) Supporting transcripts of group TB (S2).
(iii) Supporting transcripts from both groups (S3).

Library and clones number scores described above were given to SI group.

Fisher Exact Test P-values were used to check if:

S1 is significantly enriched by cancer EST clones compared to S2; and

S1 is significantly enriched by cancer EST clones compared to cluster background (S1+S2+S3).

Identification of unique sequence regions and division of the group of transcripts accordingly is illustrated in FIG. 2. Each of these unique sequence regions corresponds to a segment, also termed herein a "node".

Region 1: common to all transcripts, thus it is preferably not considered for determining differential expression between variants; Region 2: specific to Transcript 1; Region 3: specific to Transcripts 2+3; Region 4: specific to Transcript 3; Region 5: specific to Transcripts 1 and 2; Region 6: specific to Transcript 1.

EXAMPLE 5

Identification of Cancer Specific Splice Variants of Genes Over Expressed in Cancer A search for EST supported (no mRNA) regions for genes of:
(i) known cancer markers
(ii) Genes shown to be over-expressed in cancer in published micro-array experiments.

Reliable EST supported-regions were defined as supported by minimum of one of the following:
(i) 3 spliced ESTs; or
(ii) 2 spliced ESTs from 2 libraries;
(iii) 10 unspliced ESTs from 2 libraries, or
(iv) 3 libraries.

Actual Marker Examples

The following examples relate to specific actual marker examples. It should be noted that Table numbering is restarted within each example related to a particular Cluster, as indicated by the titles below.

EXPERIMENTAL EXAMPLES SECTION

This Section relates to Examples describing experiments involving these sequences, and illustrative, non-limiting examples of methods, assays and uses thereof. The materials and experimental procedures are explained first, as all experiments used them as a basis for the work that was performed.

The markers of the present invention were tested with regard to their expression in various cancerous and non-cancerous tissue samples. A description of the samples used in the panel is provided in Table 1 below. A description of the samples used in the normal tissue panel is provided in Table 2 below. Tests were then performed as described in the "Materials and Experimental Procedures" section below.

TABLE 1

Tissue samples in testing panel

| Sample name | Lot number | Source | Tissue | Pathology | Grade | gender/age |
| --- | --- | --- | --- | --- | --- | --- |
| 2-A-Pap Adeno G2 | ILS-1408 | ABS | ovary | Papillary adenocarcinoma | 2 | 53/F |
| 3-A-Pap Adeno G2 | ILS-1431 | ABS | ovary | Papillary adenocarcinoma | 2 | 52/F |
| 4-A-Pap CystAdeno G2 | ILS-7286 | ABS | ovary | Papillary cystadenocarcinoma | 2 | 50/F |
| 1-A-Pap Adeno G3 | ILS-1406 | ABS | ovary | Papillary adenocarcinoma | 3 | 73/F |
| 14-B-Adeno G2 | A501111 | BioChain | ovary | Adenocarcinoma | 2 | 41/F |
| 5-G-Adeno G3 | 99-12-G432 | GOG | ovary | Adenocarcinoma (Stage 3C) | 3 | 46/F |
| 6-A-Adeno G3 | A0106 | ABS | ovary | adenocarcinoma | 3 | 51/F |
| 7-A-Adeno G3 | IND-00375 | ABS | ovary | adenocarcinoma | 3 | 59/F |
| 8-B-Adeno G3 | A501113 | BioChain | ovary | adenocarcinoma | 3 | 60/F |
| 9-G-Adeno G3 | 99-06-G901 | GOG | ovary | Adenocarcinoma (maybe serous) | 3 | 84/F |
| 10-B-Adeno G3 | A407069 | Biochain | ovary | Adenocarcinoma | 3 | 60/F |
| 11-B-Adeno G3 | A407068 | Biochain | ovary | Adenocarcinoma | 3 | 49/F |
| 12-B-Adeno G3 | A406023 | Biochain | ovary | Adenocarcinoma | 3 | 45/F |
| 13-G-Adeno G3 | 94-05-7603 | GOG | right ovary | Metastasis adenocarcinoma | 3 | 67/F |
| 15-B-Adeno G3 | A407065 | BioChain | ovary | Carcinoma | 3 | 27/F |
| 16-Ct-Adeno | 1090387 | Clontech | ovary | Carcinoma NOS | | F |
| 22-A-Muc CystAde G2 | A0139 | ABS | ovary | Mucinous cystadenocarcinoma (Stage 1C) | 2 | 72/F |
| 21-G-Muc CystAde G2-3 | 95-10-G020 | GOG | ovary | Mucinous cystadenocarcinoma (Stage 2) | 2-3 | 44/F |
| 23-A-Muc CystAde G3 | VNM-00187 | ABS | ovary | Mucinous cystadenocarcinoma with low malignant | 3 | 45/F |
| 17-B-Muc Adeno G3 | A504084 | BioChain | ovary | Mucinous adenocarcinoma | 3 | 51/F |
| 18-B-Muc Adeno G3 | A504083 | BioChain | ovary | Mucinous adenocarcinoma | 3 | 45/F |
| 19-B-Muc Adeno G3 | A504085 | BioChain | ovary | Mucinous adenocarcinoma | | 34/F |
| 20-A-Pap Muc CystAde | USA-00273 | ABS | ovary | Papillary mucinous cystadenocarcinoma | | 45/F |

TABLE 1-continued

Tissue samples in testing panel

| Sample name | Lot number | Source | Tissue | Pathology | Grade | gender/age |
|---|---|---|---|---|---|---|
| 33-B-Pap Sero CystAde G1 | A503175 | BioChain | ovary | Serous papillary cystadenocarcinoma | 1 | 41/F |
| 25-A-Pap Sero Adeno G3 | N0021 | ABS | ovary | Papillary serous adenocarcinoma (Stage T3CN1MX) | 3 | 55/F |
| 24-G-Pap Sero Adeno G3 | 2001-07-G801 | GOG | ovary | Papillary serous adenocarcinoma | 3 | 68/F |
| 30-G-Pap Sero Adeno G3 | 2001-08-G011 | GOG | ovary | Papillary serous carcinoma (Stage 1C) | 3 | 72/F |
| 70-G-Pap Sero Adeno G3 | 95-08-G069 | GOG | ovary | Papillary serous adenocarcinoma | 3 | F |
| 31-B-Pap Sero CystAde G3 | A503176 | BioChain | ovary | Serous papillary cystadenocarcinoma | 3 | 52/F |
| 32-G-Pap Sero CystAde G3 | 93-09-4901 | GOG | ovary | Serous papillary cystadenocarcinoma | 3 | F |
| 66-G-Pap Sero Adeno G3 SIV | 2000-01-G413 | GOG | ovary | Papillary serous carcinoma (metastais of primary peritoneum) (Stage 4) | | F |
| 29-G-Sero Adeno G3 | 2001-12-G035 | GOG | right ovary | Serous adenocarcinoma (Stage 3A) | 3 | 50/F |
| 41-G-Mix Sero/Muc/Endo G2 | 98-03-G803 | GOG | ovary | Mixed epithelial cystadenocarcinoma with mucinous, endometrioid, squamous and papillary serous (Stage 2) | 2 | 38 |
| 40-G-Mix Sero/Endo G2 | 95-11-G006 | GOG | ovary, endometrium | Papillary serous and endometrioid cystadenocarcinoma (Stage 3C) | 2 | 49/F |
| 37-G-Mix Sero/Endo G3 | 2002-05-G513 | GOG | ovary | Mixed serous and endometrioid adenocarcinoma | 3 | 56/F |
| 38-G-Mix Sero/Endo G3 | 2002-05-G509 | GOG | ovary | Mixed serous and endometrioid adenocarcinoma of mullerian (Stage 3C) | 3 | 64/F |
| 39-G-Mix Sero/Endo G3 | 2001-12-G037 | GOG | ovary | Mixed serous and endometrioid adenocarcinoma | 3 | F |
| 36-G-Endo Adeno G1-2 | 2000-09-G612 | GOG | ovary | Endometrial adenocarcinoma | 1-2 | 69/F |
| 35-G-Endo Adeno G2 | 94-08-7604 | GOG | right ovary | Endometriold adenocarcinoma | 2 | 39/F |
| 34-G-Pap Endo Adeno G3 | 95-04-2002 | GOG | ovary | Papillary endometrioid adenocarcinoma (Stage 3C) | 3 | 68/F |
| 43-G-Clear cell Adeno G3 | 2001-10-G002 | GOG | ovary | Clear cell adenocarcinoma | 3 | 74/F |
| 44-G-Clear cell Adeno | 2001-07-G084 | GOG | ovary | Clear cell adenocarcinoma (Stage 3A) | | 73/F |
| 42-G-Adeno borderline | 98-08-G001 | GOG | ovary | Epithelial adenocarcinoma of borderline malignancy | | 46/F |
| 59-G-Sero CysAdenoFibroma | 98-12-G401 | GOG | ovary | Serous CysAdenoFibroma | | 77/F |
| 63-G-Sero CysAdenoFibroma | 2000-10-G620 | GOG | ovary | Serous CysAdenoFibroma of borderline malignancy | | 71/F |
| 64-G-Ben Sero CysAdenoma | 99-06-G039 | GOG | ovary | Bengin Serous CysAdenoma | | 57/F |
| 56-G-Ben Muc CysAdeno | 99-01-G407 | GOG | left ovary | Bengin mucinus cysadenoma | | 46/F |
| 62-G-Ben Muc CysAdenoma | 99-10-G442 | GOG | ovary | Bengin mucinus cysadenoma | | 32/F |
| 60-G-Muc CysAdenoma | 99-01-G043 | GOG | ovary | Mucinous Cysadenoma | | 40/F |
| 61-G-Muc CysAdenoma | 99-07-G011 | GOG | ovary | Mucinous Cysadenoma | | 63/F |
| 65-G-Edometrioma | 97-11-G320 | GOG | right ovary | Endometrioma | | 41/F |
| 57-B-Thecoma | A407066 | BioChain | ovary | Thecoma | | 56/F |
| 58-CG-Struteratoma | CG-177 | Ichilov | ovary | Struma ovary/monodermal teratoma | | 58/F |
| 50-B-N M8 | A501114 | BioChain | ovary | Normal (matched tumor A501113) | | 60/F |
| 49-B-N M14 | A501112 | BioChain | ovary | Normal (matched tumor A501111) | | 41/F |

TABLE 1-continued

Tissue samples in testing panel

| Sample name | Lot number | Source | Tissue | Pathology | Grade | gender/age |
|---|---|---|---|---|---|---|
| 69-G-N M24 | 2001-07-G801N | GOG | ovary | Normal (matched tumor 2001-07-G801) | | 68/F |
| 67-G-N M38 | 2002-05-509N | GOG | ovary | Normal (matched tumor 2002-05-G509) | | 64/F |
| 51-G-N M41 | 98-03-G803N | GOG | ovary | Normal (matched tumor 98-03-G803) | | 38/F |
| 52-G-N M42 | 98-08-G001N | GOG | ovary | Normal (matched tumor 98-08-G001) | | 46/F |
| 68-G-N M56 | 99-01-G407N | GOG | ovary | Normal (matched bengin 99-01-G407) | | 46/F |
| 72-G-N M66 | 2000-01-G413N | GOG | ovary | Normal (matched tumor 2000-01-G413) | | F |
| 73-G-N M59 | 98-12-G401N | GOG | ovary | Normal (matched tumor 98-12-G401) | | 77/F |
| 74-G-N M65 | 97-11-G320N | GOG | ovary | Normal (matched tumor 97-11G320) | | 41/F |
| 75-G-N M60 | 99-01-G043N | GOG | ovary | Normal (matched tumor 99-01-G043) | | 40/F |
| 45-B-N | A503274 | BioChain | ovary | Normal PM | | 41/F |
| 46-B-N | A504086 | BioChain | ovary | Normal PM | | 41/F |
| 48-B-N | A504087 | BioChain | ovary | Normal PM | | 51/F |
| 47-Am-N | 061P43A | Ambion | ovary | Normal (CLOSED HEAD) | | 16/F |
| 71-CG-N | CG-188-7 | Ichilov | ovary | Normal PM | | 49/F |

TABLE 2

Tissue samples in normal panel:

| | Lot no. | Source | Tissue | Pathology | Sex/Age |
|---|---|---|---|---|---|
| 1-Am-Colon (C71) | 071P10B | Ambion | Colon | PM | F/43 |
| 2-B-Colon (C69) | A411078 | Biochain | Colon | PM-Pool of 10 | M&F |
| 3-Cl-Colon (C70) | 1110101 | Clontech | Colon | PM-Pool of 3 | M&F |
| 4-Am-Small Intestine | 091P0201A | Ambion | Small Intestine | PM | M/75 |
| 5-B-Small Intestine | A501158 | Biochain | Small Intestine | PM | M/63 |
| 6-B-Rectum | A605138 | Biochain | Rectum | PM | M/25 |
| 7-B-Rectum | A610297 | Biochain | Rectum | PM | M/24 |
| 8-B-Rectum | A610298 | Biochain | Rectum | PM | M/27 |
| 9-Am-Stomach | 110P04A | Ambion | Stomach | PM | M/16 |
| 10-B-Stomach | A501159 | Biochain | Stomach | PM | M/24 |
| 11-B-Esophagus | A603814 | Biochain | Esophagus | PM | M/26 |
| 12-B-Esophagus | A603813 | Biochain | Esophagus | PM | M/41 |
| 13-Am-Pancreas | 071P25C | Ambion | Pancreas | PM | M/25 |
| 14-CG-Pancreas | CG-255-2 | Ichilov | Pancreas | PM | M/75 |
| 15-B-Lung | A409363 | Biochain | Lung | PM | F/26 |
| 16-Am-Lung (L93) | 111P0103A | Ambion | Lung | PM | F/61 |
| 17-B-Lung (L92) | A503204 | Biochain | Lung | PM | M/28 |
| 18-Am-Ovary (O47) | 061P43A | Ambion | Ovary | PM | F/16 |
| 19-B-Ovary (O48) | A504087 | Biochain | Ovary | PM | F/51 |
| 20-B-Ovary (O46) | A504086 | Biochain | Ovary | PM | F/41 |
| 21-Am-Cervix | 101P0101A | Ambion | Cervix | PM | F/40 |
| 22-B-Cervix | A408211 | Biochain | Cervix | PM | F/36 |
| 23-B-Cervix | A504089 | Biochain | Cervix | PM-Pool of 5 | M&F |
| 24-B-Uterus | A411074 | Biochain | Uterus | PM-Pool of 10 | M&F |
| 25-B-Uterus | A409248 | Biochain | Uterus | PM | F/43 |
| 26-B-Uterus | A504090 | Biochain | Uterus | PM-Pool of 5 | M&F |
| 27-B-Bladder | A501157 | Biochain | Bladder | PM | M/29 |
| 28-Am-Bladder | 071P02C | Ambion | Bladder | PM | M/20 |
| 29-B-Bladder | A504088 | Biochain | Bladder | PM-Pool of 5 | M&F |
| 30-Am-Placenta | 021P33A | Ambion | Placenta | PB | F/33 |
| 31-B-Placenta | A410165 | Biochain | Placenta | PB | F/26 |
| 32-B-Placenta | A411073 | Biochain | Placenta | PB-Pool of 5 | M&F |
| 33-B-Breast (B59) | A607155 | Biochain | Breast | PM | F/36 |
| 34-Am-Breast (B63) | 26486 | Ambion | Breast | PM | F/43 |
| 35-Am-Breast (B64) | 23036 | Ambion | Breast | PM | F/57 |
| 36-Cl-Prostate (P53) | 1070317 | Clontech | Prostate | PB-Pool of 47 | M&F |
| 37-Am-Prostate (P42) | 061P04A | Ambion | Prostate | PM | M/47 |
| 38-Am-Prostate (P59) | 25955 | Ambion | Prostate | PM | M/62 |
| 39-Am-Testis | 111P0104A | Ambion | Testis | PM | M/25 |
| 40-B-Testis | A411147 | Biochain | Testis | PM | M/74 |
| 41-Cl-Testis | 1110320 | Clontech | Testis | PB-Pool of 45 | M&F |
| 42-CG-Adrenal | CG-184-10 | Ichilov | Adrenal | PM | F/81 |

TABLE 2-continued

Tissue samples in normal panel:

| | Lot no. | Source | Tissue | Pathology | Sex/Age |
|---|---|---|---|---|---|
| 43-B-Adrenal | A610374 | Biochain | Adrenal | PM | F/83 |
| 44-B-Heart | A411077 | Biochain | Heart | PB-Pool of 5 | M&F |
| 45-CG-Heart | CG-255-9 | Ichilov | Heart | PM | M/75 |
| 46-CG-Heart | CG-227-1 | Ichilov | Heart | PM | F/36 |
| 47-Am-Liver | 081P0101A | Ambion | Liver | PM | M/64 |
| 48-CG-Liver | CG-93-3 | Ichilov | Liver | PM | F/19 |
| 49-CG-Liver | CG-124-4 | Ichilov | Liver | PM | F/34 |
| 50-Cl-BM | 1110932 | Clontech | Bone Marrow | PM-Pool of 8 | M&F |
| 51-CGEN-Blood | WBC#5 | CGEN | Blood | | M |
| 52-CGEN-Blood | WBC#4 | CGEN | Blood | | M |
| 53-CGEN-Blood | WBC#3 | CGEN | Blood | | M |
| 54-CG-Spleen | CG-267 | Ichilov | Spleen | PM | F/25 |
| 55-CG-Spleen | 111P0106B | Ambion | Spleen | PM | M/25 |
| 56-CG-Spleen | A409246 | Biochain | Spleen | PM | F/12 |
| 56-CG-Thymus | CG-98-7 | Ichilov | Thymus | PM | F/28 |
| 58-Am-Thymus | 101P0101A | Ambion | Thymus | PM | M/14 |
| 59-B-Thymus | A409278 | Biochain | Thymus | PM | M/28 |
| 60-B-Thyroid | A610287 | Biochain | Thyroid | PM | M/27 |
| 61-B-Thyroid | A610286 | Biochain | Thyroid | PM | M/24 |
| 62-CG-Thyroid | CG-119-2 | Ichilov | Thyroid | PM | F/66 |
| 63-Cl-Salivary Gland | 1070319 | Clontech | Salivary Gland | PM-Pool of 24 | M&F |
| 64-Am-Kidney | 111P0101B | Ambion | Kidney | PM-Pool of 14 | M&F |
| 65-Cl-Kidney | 1110970 | Clontech | Kidney | PM-Pool of 14 | M&F |
| 66-B-Kidney | A411080 | Biochain | Kidney | PM-Pool of 5 | M&F |
| 67-CG-Cerebellum | CG-183-5 | Ichilov | Cerebellum | PM | M/74 |
| 68-CG-Cerebellum | CG-212-5 | Ichilov | Cerebellum | PM | M/54 |
| 69-B-Brain | A411322 | Biochain | Brain | PM | M/28 |
| 70-Cl-Brain | 1120022 | Clontech | Brain | PM-Pool of 2 | M&F |
| 71-B-Brain | A411079 | Biochain | Brain | PM-Pool of 2 | M&F |
| 72-CG-Brain | CG-151-1 | Ichilov | Brain | PM | F/86 |
| 73-Am-Skeletal Muscle | 101P013A | Ambion | Skeletal Muscle | PM | F/28 |
| 74-Cl-Skeletal Muscle | 1061038 | Clontech | Skeletal Muscle | PM-Pool of 2 | M&F |

Materials and Experimental Procedures

RNA preparation—RNA was obtained from Clontech (Franklin Lakes, N.J. USA 07417, clontech.com), BioChain Inst. Inc. (Hayward, Calif. 94545 USA biochain.com), ABS (Wilmington, Del. 19801, USA, absbioreagents.com) or Ambion (Austin, Tex. 78744 USA, ambion.com). Alternatively, RNA was generated from tissue samples using TRI-Reagent (Molecular Research Center), according to Manufacturer's instructions. Tissue and RNA samples were obtained from patients or from postmortem. Total RNA samples were treated with DNaseI (Ambion) and purified using RNeasy columns (Qiagen).

RT PCR—Purified RNA (1 µg) was mixed with 150 ng Random Hexamer primers (Invitrogen) and 500 µM dNTP in a total volume of 15.6 µl. The mixture was incubated for 5 min at 65° C. and then quickly chilled on ice. Thereafter, 5 µl of 5× SuperscriptII first strand buffer (Invitrogen), 2.4 µl 0.1M DTT and 40 units RNasin (Promega) were added, and the mixture was incubated for 10 min at 25° C., followed by further incubation at 42° C. for 2 min. Then, 1 µl (200 units) of SuperscriptII (Invitrogen) was added and the reaction (final volume of 25 µl) was incubated for 50 min at 42° C. and then inactivated at 70° C. for 15 min. The resulting cDNA was diluted 1:20 in TE buffer (10 mM Tris pH=8, 1 mM EDTA pH=8).

Real-Time RT-PCR analysis—cDNA (511), prepared as described above, was used as a template in Real-Time PCR reactions using the SYBR Green I assay (PE Applied Biosystem) with specific primers and UNG Enzyme (Eurogentech or ABI or Roche). The amplification was effected as follows: 50° C. for 2 min, 95° C. for 10 min, and then 40 cycles of 95° C. for 15 sec, followed by 60° C. for 1 min. Detection was performed by using the PE Applied Biosystem SDS 7000. The cycle in which the reactions achieved a threshold level (Ct) of fluorescence was registered and was used to calculate the relative transcript quantity in the RT reactions. The relative quantity was calculated using the equation $Q=\text{efficiency}^{-Ct}$. The efficiency of the PCR reaction was calculated from a standard curve, created by using serial dilutions of several reverse transcription (RT) reactions. To minimize inherent differences in the RT reaction, the resulting relative quantities were normalized to the geometric mean of the relative quantities of several housekeeping (HSKP) genes. Schematic summary of quantitative real-time PCR analysis is presented in FIG. 3. As shown, the x-axis shows the cycle number. The $C_T$=Threshold Cycle point, which is the cycle that the amplification curve crosses the fluorescence threshold that was set in the experiment. This point is a calculated cycle number in which PCR products signal is above the background level (passive dye ROX) and still in the Geometric/Exponential phase (as shown, once the level of fluorescence crosses the measurement threshold, it has a geometrically increasing phase, during which measurements are most accurate, followed by a linear phase and a plateau phase; for quantitative measurements, the latter two phases do not provide accurate measurements). The y-axis shows the normalized reporter fluorescence. It should be noted that this type of analysis provides relative quantification.

The sequences of the housekeeping genes measured in all the examples on ovarian cancerpanel were as follows:

SDHA (SEQ ID NO:1032) (GenBank Accession No. NM_004168, (SEQ ID NO:1032))

SDHA Forward primer (SEQ ID NO:1033): TGGGAACAA-GAGGGCATCTG

SDHA Reverse primer (SEQ ID NO:1034): CCACCACTG-CATCAAATTCATG

SDHA-amplicon, (SEQ ID NO: 1035): TGGGAACAA-GAGGGCATCTGCTAAAGTTTCAGATTC-CATTTCTGCTCAGTATCCAGT AGTGGATCAT-GAATTTGATGCAGTGGTGG PBGD (SEQ ID NO:1036) (GenBank Accession No. BC019323), PBGD Forward primer (SEQ ID NO:1037): TGAGAGT-GATTCGCGTGGG PBGD Reverse primer (SEQ ID NO:1038): CCAGGGTAC-GAGGCTTTCAAT PBGD-amplicon (SEQ ID NO:1039): TGAGAGTGAT-TCGCGTGGGTACCCGCAAGAGCCAGCT-TGCTCGCATACAGACGGAC AGTGTGGTGGCAACAT-TGAAAGCCTCGTACCCTGG HPRT1 (SEQ ID NO: 1040) (GenBank Accession No. NM_000194), HPRT1 Forward primer (SEQ ID NO:1041): TGACACTG-GCAAAACAATGCA HPRT1 Reverse primer (SEQ ID NO:1042): GGTC-CTTTTCACCAGCAAGCT HPRT1-amplicon (SEQ ID NO: 1043): TGACACTG-GCAAAACAATGCAGACTTTGCTTTCCT-TGGTCAGGCAGTATAATCCAA AGATGGTCAAG-GTCGCAAGCTTGCTGGTGAAAAGGACC GAPDH (SEQ ID NO: 1044) (GenBank Accession No. BC026907)

GAPDH Forward primer (SEQ ID NO:1045): TGCACCAC-CAACTGCTTAGC

GAPDH Reverse primer (SEQ ID NO:1046): CCAT-CACGCCACAGTTTCC

GAPDH-amplicon (SEQ ID NO: 1047): TGCACCAC-CAACTGCTTAGCACCCCTGGCCAAGGT-CATCCATGACAACTTTGGTATC GTGGAAGGACT-CATGACCACAGTCCATGCCATCACTGCCACCCAGAA GACTGTGGA TGG The sequences of the housekeeping genes measured in all the examples on normal tissue samples panel were as follows:

RPL19 (SEQ ID NO:1048) (GenBank Accession No. NM_000981),

RPL19 Forward primer (SEQ ID NO:1049): TGGCAAGAA-GAAGGTCTGGTTAG

RPL19 Reverse primer (SEQ ID NO:1050): TGATCAGC-CCATCTTTGATGAG

RPL19-amplicon (SEQ ID NO:1051): TGGCAAGAA-GAAGGTCTGGTTAGACCCCAATGAGAC-CAATGAAATCGCCAATGCCA ACTCCCGTCAGCA-GATCCGGAAGCTCATCAAAGATGGGCTGATCA TATA box (SEQ ID NO: 1052) (GenBank Accession No. NM_003194), TATA box Forward primer (SEQ ID NO:1053): CGGTTTGCTGCGGTAATCAT TATA box Reverse primer (SEQ ID NO:1054): TTTCT-TGCTGCCAGTCTGGAC TATA box—amplicon (SEQ ID NO:1055):
CGGTTTGCTGCGGTAATCATGAGGATAA-GAGAGCCACGAACCACGGCACTGATTTT CAGT-TCTGGGAAAATGGTGTGCACAGGAGC-CAAGAGTGAAGAACAGTCCAGACTG GCAGCAAGAAA Ubiquitin (SEQ ID NO: 1056) (GenBank Accession No. BC000449)

Ubiquitin Forward primer (SEQ ID NO:1057): ATTTGGGTCGCGGTTCTTG

Ubiquitin Reverse primer (SEQ ID NO:1058): TGCCTTGA-CATTCTCGATGGT

Ubiquitin C-amplicon (SEQ ID NO:1059): ATTTGGGTCGCGGTTCTTGTTTGTG-GATCGCTGTGATCGTCACTTGACAATGCAGAT CTTCGTGAAGACTCTGACTGGTAAGAC-CATCACCCTCGAGG TTGAGCCCAGTGACACCATC-GAGAATGTCAAGGCA SDHA (GenBank Accession No. NM_004168, (SEQ ID NO:1032))

SDHA Forward primer (SEQ ID NO:1033): TGGGAACAA-GAGGGCATCTG

SDHA Reverse primer (SEQ ID NO:1034): CCACCACTG-CATCAAATTCATG

SDHA-amplicon, (SEQ ID NO:1035): TGGGAACAA-GAGGGCATCTGCTAAAGTTTCAGATTC-CATTTCTGCTCAGTATCCAGT AGTGGATCAT-GAATTTGATGCAGTGGTGG Oligonucleotide-Based Micro-Array Experiment Protocol—

Microarray Fabrication

Microarrays (chips) were printed by pin deposition using the MicroGrid II MGII 600 robot from BioRobotics Limited (Cambridge, UK). 50-mer oligonucleotides target sequences were designed by Compugen Ltd (Tel-Aviv, Ill.) as described by A. Shoshan et al, "Optical technologies and informatics", Proceedings of SPIE. Vol 4266, pp. 86-95 (2001). The designed oligonucleotides were synthesized and purified by desalting with the Sigma-Genosys system (The Woodlands, Tex., US) and all of the oligonucleotides were joined to a C6 amino-modified linker at the 5' end, or being attached directly to CodeLink slides (Cat #25-6700-01. Amersham Bioscience, Piscataway, N.J., US). The 50-mer oligonucleotides, forming the target sequences, were first suspended in Ultrapure DDW (Cat #01-866-1A Kibbutz Beit-Haemek, Israel) to a concentration of 50 µM. Before printing the slides, the oligonucleotides were resuspended in 300 mM sodium phosphate (pH 8.5) to final concentration of 150 mM and printed at 35-40% relative humidity at 21° C.

Each slide contained a total of 9792 features in 32 subarrays. Of these features, 4224 features were sequences of interest according to the present invention and negative controls that were printed in duplicate. An additional 288 features (96 target sequences printed in triplicate) contained housekeeping genes from Human Evaluation Library2, Compugen Ltd, Israel. Another 384 features are *E. coli* spikes 1-6, which are oligos to E-Coli genes which are commercially available in the Array Control product (Array control-sense oligo spots, Ambion Inc. Austin, Tex. Cat #1781, Lot #112K06).

Post-Coupling Processing of Printed Slides

After the spotting of the oligonucleotides to the glass (CodeLink) slides, the slides were incubated for 24 hours in a sealed saturated NaCl humidification chamber (relative humidity 70-75%).

Slides were treated for blocking of the residual reactive groups by incubating them in blocking solution at 50° C. for 15 minutes (10 ml/slide of buffer containing 0.1M Tris, 50 mM ethanolamine, 0.1% SDS). The slides were then rinsed twice with Ultra-pure DDW (double distilled water). The slides were then washed with wash solution (10 ml/slide. 4×SSC, 0.1% SDS)) at 50° C. for 30 minutes on the shaker. The slides were then rinsed twice with Ultra-pure DDW, followed by drying by centrifugation for 3 minutes at 800 rpm.

Next, in order to assist in automatic operation of the hybridization protocol, the slides were treated with Ventana Discovery hybridization station barcode adhesives. The printed slides were loaded on a Bio-Optica (Milan, Italy) hematology staining device and were incubated for 10 minutes in 50 ml of 3-Aminopropyl Triethoxysilane (Sigma A3648 lot #122K589). Excess fluid was dried and slides were then incubated for three hours in 20 mm/Hg in a dark vacuum desiccator (Pelco 2251, Ted Pella, Inc. Redding Calif.).

The following protocol was then followed with the Genisphere 900-RP (random primer), with mini elute columns on the Ventana Discovery HybStation™, to perform the microarray experiments. Briefly, the protocol was performed as described with regard to the instructions and information provided with the device itself. The protocol included cDNA synthesis and labeling. cDNA concentration was measured with the TBS-380 (Turner Biosystems. Sunnyvale, Calif.) PicoFlour, which is used with the OliGreen ssDNA Quantitation reagent and kit.

Hybridization was performed with the Ventana Hybridization device, according to the provided protocols (Discovery Hybridization Station Tuscon Ariz.).

The slides were then scanned with GenePix 4000B dual laser scanner from Axon Instruments Inc, and analyzed by GenePix Pro 5.0 software.

Schematic summary of the oligonucleotide based microarray fabrication and the experimental flow is presented in FIGS. 4 and 5.

Briefly, as shown in FIG. 4, DNA oligonucleotides at 25 uM were deposited (printed) onto Amersham 'CodeLink' glass slides generating a well defined 'spot'. These slides are covered with a long-chain, hydrophilic polymer chemistry that creates an active 3-D surface that covalently binds the DNA oligonucleotides 5'-end via the C6-amine modification. This binding ensures that the full length of the DNA oligonucleotides is available for hybridization to the cDNA and also allows lower background, high sensitivity and reproducibility.

FIG. 5 shows a schematic method for performing the microarray experiments. It should be noted that stages on the left-hand or right-hand side may optionally be performed in any order, including in parallel, until stage 4 (hybridization). Briefly, on the left-hand side, the target oligonucleotides are being spotted on a glass microscope slide (although optionally other materials could be used) to form a spotted slide (stage 1). On the right hand side, control sample RNA and cancer sample RNA are Cy3 and Cy5 labeled, respectively (stage 2), to form labeled probes. It should be noted that the control and cancer samples come from corresponding tissues (for example, normal prostate tissue and cancerous prostate tissue). Furthermore, the tissue from which the RNA was taken is indicated below in the specific examples of data for particular clusters, with regard to overexpression of an oligonucleotide from a "chip" (microarray), as for example "prostate" for chips in which prostate cancerous tissue and normal tissue were tested as described above. In stage 3, the probes are mixed. In stage 4, hybridization is performed to form a processed slide. In stage 5, the slide is washed and scanned to form an image file, followed by data analysis in stage 6.

DESCRIPTION FOR CLUSTER H61775

Cluster H61775 features 2 transcript(s) and 6 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO |
|---|---|
| H61775_T21 (SEQ ID NO: 1) | 1 |
| H61775_T22 (SEQ ID NO: 2) | 2 |

TABLE 2

Segments of interest

| Segment Name | SEQ ID NO |
|---|---|
| H61775_node_2 (SEQ ID NO: 3) | 3 |
| H61775_node_4 (SEQ ID NO: 4) | 4 |
| H61775_node_6 (SEQ ID NO: 5) | 5 |
| H61775_node_8 (SEQ ID NO: 6) | 6 |
| H61775_node_0 (SEQ ID NO: 7) | 7 |
| H61775_node_5 (SEQ ID NO: 8) | 8 |

TABLE 3

Proteins of interest

| Protein Name | SEQ ID NO |
|---|---|
| H61775_P16 (SEQ ID NO: 9) | 9 |
| H61775_P17 (SEQ ID NO: 10) | 10 |

Cluster H61775 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 6 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 6 and Table 4. This cluster is overexpressed (at least at a minimum level) in the following pathological conditions: brain malignant tumors and a mixture of malignant tumors from different tissues.

TABLE 4

Normal tissue distribution

| Name of Tissue | Number |
|---|---|
| bladder | 0 |
| brain | 0 |
| colon | 0 |
| epithelial | 10 |
| general | 3 |
| breast | 8 |
| muscle | 0 |

TABLE 4-continued

Normal tissue distribution

| Name of Tissue | Number |
|---|---|
| ovary | 0 |
| pancreas | 0 |
| prostate | 0 |
| uterus | 0 |

TABLE 5

P values and ratios for expression in cancerous tissue

| Name of Tissue | P1 | P2 | SP1 | R3 | SP2 | R4 |
|---|---|---|---|---|---|---|
| bladder | 3.1e−01 | 3.8e−01 | 3.2e−01 | 2.5 | 4.6e−01 | 1.9 |
| brain | 8.8e−02 | 6.5e−02 | 1 | 3.5 | 4.1e−04 | 5.8 |
| colon | 5.6e−01 | 6.4e−01 | 1 | 1.1 | 1 | 1.1 |
| epithelial | 3.0e−02 | 1.3e−01 | 2.3e−02 | 2.1 | 3.2e−01 | 1.2 |
| general | 1.3e−06 | 4.9e−05 | 1.0e−07 | 6.3 | 1.5e−06 | 4.3 |
| breast | 4.7e−01 | 3.7e−01 | 3.3e−01 | 2.0 | 4.6e−01 | 1.6 |
| muscle | 2.3e−01 | 2.9e−01 | 1.5e−01 | 6.8 | 3.9e−01 | 2.6 |
| ovary | 3.8e−01 | 4.2e−01 | 1.5e−01 | 2.4 | 2.6e−01 | 1.9 |
| pancreas | 3.3e−01 | 4.4e−01 | 4.2e−01 | 2.4 | 5.3e−01 | 1.9 |
| prostate | 7.3e−01 | 7.8e−01 | 6.7e−01 | 1.5 | 7.5e−01 | 1.3 |
| uterus | 1.0e−01 | 2.6e−01 | 2.9e−01 | 2.6 | 5.1e−01 | 1.8 |

As noted above, cluster H61775 features 2 transcript(s), which were listed in Table 1 above. A description of each variant protein according to the present invention is now provided.

Variant protein H61775_P16 (SEQ ID NO: 9) according to the present invention has an amino acid sequence as given at the end of the application; it is encoded by transcript(s) H61775_T21 (SEQ ID NO: 1). One or more alignments to one or more previously published protein sequences are given at the end of the application. A brief description of the relationship of the variant protein according to the present invention to each such aligned protein is as follows:

Comparison report between H61775_P16 (SEQ ID NO: 9) and Q9P2J2 (SEQ ID NO: 953) (SEQ ID NO:953):

1. An isolated chimeric polypeptide encoding for H61775_P16 (SEQ ID NO: 9), comprising a first amino acid sequence being at least 90% homologous to MVWCLGLAV-LSLVISQGADGRGKPEVVSVVGRAGESV-VLGCDLLPPAGRPPLHVIEWL RFGFLLPIFIQF-GLYSPRIDPDYVG corresponding to amino acids 11-93 of Q9P2J2 (SEQ ID NO: 953), which also corresponds to amino acids 1-83 of H61775_P16 (SEQ ID NO: 9), and a second amino acid sequence being at least 70%, optionally at least 80%, preferably at least 85%, more preferably at least 90% and most preferably at least 95% homologous to a polypeptide having the sequence DCGFPAFRELKRA-ETVSPVFFTRRCIWEDLKSTGF-SPAGGGRPPGGGPRTQEDSGLPCW RSSCSVTLQV (SEQ ID NO: 1110) corresponding to amino acids 84-152 of H61775_P16 (SEQ ID NO: 9), wherein said first and second amino acid sequences are contiguous and in a sequential order.

2. An isolated polypeptide encoding for a tail of H61775_P16 (SEQ ID NO: 9), comprising a polypeptide being at least 70%, optionally at least about 80%, preferably at least about 85%, more preferably at least about 90% and most preferably at least about 95% homologous to the sequence DCGFPAFRELKRAETVSPVFFTRRCIW-EDLKSTGFSPAGGGRPPGGGPRTQEDSGLPCW RSSCSVTLQV (SEQ ID NO: 1110) in H61775_P16 (SEQ ID NO: 9).

Comparison report between H61775_P16 (SEQ ID NO: 9) and AAQ88495 (SEQ ID NO: 954) (SEQ ID NO:954):

1. An isolated chimeric polypeptide encoding for H61775_P16 (SEQ ID NO: 9), comprising a first amino acid sequence being at least 90% homologous to MVWCLGLAV-LSLVISQGADGRGKPEVVSVVGRAGESV-VLGCDLLPPAGRPPLHVIEWL RFGFLLPIFIQF-GLYSPRIDPDYVG corresponding to amino acids 1-83 of AAQ88495 (SEQ ID NO: 954), which also corresponds to amino acids 1-83 of H61775_P16 (SEQ ID NO: 9), and a second amino acid sequence being at least 70%, optionally at least 80%, preferably at least 85%, more preferably at least 90% and most preferably at least 95% homologous to a polypeptide having the sequence DCGFPAFRELKRA-ETVSPVFFTRRCIWEDLKSTGF-SPAGGGRPPGGGPRTQEDSGLPCW RSSCSVTLQV (SEQ ID NO: 1110) corresponding to amino acids 84-152 of H61775_P16 (SEQ ID NO: 9), wherein said first and second amino acid sequences are contiguous and in a sequential order.

2. An isolated polypeptide encoding for a tail of H61775_P16 (SEQ ID NO: 9), comprising a polypeptide being at least 70%, optionally at least about 80%, preferably at least about 85%, more preferably at least about 90% and most preferably at least about 95% homologous to the sequence DCGFPAFRELKRAETVSPVFFTRRCIW-EDLKSTGFSPAGGGRPPGGGPRTQEDSGLPCW RSSCSVTLQV (SEQ ID NO: 1110) in H61775_P16 (SEQ ID NO: 9).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H61775_P16 (SEQ ID NO: 9) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein H61775_P16 (SEQ ID NO: 9) sequence provides support for the deduced sequence of this variant protein according to the present invention).

TABLE 6

Amino acid mutations

| SNP position(s) on amino acid sequence | Alternative amino acid(s) | Previously known SNP? |
|---|---|---|
| 14 | I -> T | No |
| 138 | G -> R | No |
| 34 | G -> E | Yes |
| 48 | G -> R | No |
| 91 | R -> * | Yes |

Variant protein H61775_P16 (SEQ ID NO: 9) is encoded by the following transcript(s): H61775_T21 (SEQ ID NO: 1), for which the sequence(s) is/are given at the end of the application. The coding portion of transcript H61775_T21 (SEQ ID NO: 1) is shown in bold; this coding portion starts at position 261 and ends at position 716. The transcript also has the following SNPs as listed in Table 7 (given according to their position on the nucleotide sequence, with the alternative nucleic acid listed; the last column indicates whether the SNP is known or not; the presence of known SNPs in variant protein H61775_P16 (SEQ ID NO: 9) sequence provides support for the deduced sequence of this variant protein according to the present invention).

TABLE 7

Nucleic acid SNPs

| SNP position on nucleotide sequence | Alternative nucleic acid | Previously known SNP? |
| --- | --- | --- |
| 117 | T -> C | Yes |
| 200 | T -> C | No |
| 672 | G -> C | No |
| 222 | T -> C | Yes |
| 301 | T -> C | No |
| 361 | G -> A | Yes |
| 377 | G -> A | No |
| 400 | -> C | No |
| 402 | G -> C | No |
| 531 | C -> T | Yes |
| 566 | T -> C | No |

Variant protein H61775_P17 (SEQ ID NO: 10) according to the present invention has an amino acid sequence as given at the end of the application; it is encoded by transcript(s) H61775_T22 (SEQ ID NO: 2). One or more alignments to one or more previously published protein sequences are given at the end of the application. A brief description of the relationship of the variant protein according to the present invention to each such aligned protein is as follows:

Comparison report between H61775_P17 (SEQ ID NO: 10) and Q9P2J2 (SEQ ID NO: 953):

1. An isolated chimeric polypeptide encoding for H61775_P17 (SEQ ID NO: 10), comprising a first amino acid sequence being at least 90% homologous to MVWCLGLAV-LSLVISQGADGRGKPEVVSVVGRAGESV-VLGCDLLPPAGRPPLHVIEWL RFGFLLPIFIQF-GLYSPRIDPDYVG corresponding to amino acids 11-93 of Q9P2J2 (SEQ ID NO: 953), which also corresponds to amino acids 1-83 of H61775_P17 (SEQ ID NO: 10).

Comparison report between H61775_P17 (SEQ ID NO: 10) and AAQ88495 (SEQ ID NO: 954):

1. An isolated chimeric polypeptide encoding for H61775_P17 (SEQ ID NO: 10), comprising a first amino acid sequence being at least 90% homologous to MVWCLGLAV-LSLVISQGADGRGKPEVVSVVGRAGESV-VLGCDLLPPAGRPPLHVIEWL RFGFLLPIFIQF-GLYSPRIDPDYVG corresponding to amino acids 1-83 of AAQ88495 (SEQ ID NO: 954), which also corresponds to amino acids 1-83 of H61775_P17 (SEQ ID NO: 10).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H61775_P17 (SEQ ID NO: 10) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein H61775_P17 (SEQ ID NO: 10) sequence provides support for the deduced sequence of this variant protein according to the present invention).

TABLE 8

Amino acid mutations

| SNP position(s) on amino acid sequence | Alternative amino acid(s) | Previously known SNP? |
| --- | --- | --- |
| 14 | I -> T | No |
| 34 | G -> E | Yes |
| 48 | G -> R | No |

Variant protein H61775_P17 (SEQ ID NO: 10) is encoded by the following transcript(s): H61775_T22 (SEQ ID NO: 2), for which the sequence(s) is/are given at the end of the application. The coding portion of transcript H61775_T22 (SEQ ID NO: 2) is shown in bold; this coding portion starts at position 261 and ends at position 509. The transcript also has the following SNPs as listed in Table 9 (given according to their position on the nucleotide sequence, with the alternative nucleic acid listed; the last column indicates whether the SNP is known or not; the presence of known SNPs in variant protein H61775_P17 (SEQ ID NO: 10) sequence provides support for the deduced sequence of this variant protein according to the present invention).

TABLE 9

Nucleic acid SNPs

| SNP position on nucleotide sequence | Alternative nucleic acid | Previously known SNP? |
| --- | --- | --- |
| 117 | T -> C | Yes |
| 200 | T -> C | No |
| 222 | T -> C | Yes |
| 301 | T -> C | No |
| 361 | G -> A | Yes |
| 377 | G -> A | No |
| 400 | -> C | No |
| 402 | G -> C | No |
| 596 | T -> A | Yes |

As noted above, cluster H61775 features 6 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster H61775_node__2 (SEQ ID NO: 3) according to the present invention is supported by 17 libraries. The number of libraries was determined as previously described. This segment can be found in the following transcript(s): H61775_T21 (SEQ ID NO: 1) and H61775_T22 (SEQ ID NO: 2). Table 10 below describes the starting and ending position of this segment on each transcript.

TABLE 10

Segment location on transcripts

| Transcript name | Segment starting position | Segment ending position |
|---|---|---|
| H61775_T21 (SEQ ID NO: 1) | 87 | 318 |
| H61775_T22 (SEQ ID NO: 2) | 87 | 318 |

Segment cluster H61775_node_4 (SEQ ID NO: 4) according to the present invention is supported by 20 libraries. The number of libraries was determined as previously described. This segment can be found in the following transcript(s): H61775_T21 (SEQ ID NO: 1) and H61775_T22 (SEQ ID NO: 2). Table 11 below describes the starting and ending position of this segment on each transcript.

TABLE 11

Segment location on transcripts

| Transcript name | Segment starting position | Segment ending position |
|---|---|---|
| H61775_T21 (SEQ ID NO: 1) | 319 | 507 |
| H61775_T22 (SEQ ID NO: 2) | 319 | 507 |

Segment cluster H61775_node_6 (SEQ ID NO: 5) according to the present invention is supported by 1 libraries. The number of libraries was determined as previously described. This segment can be found in the following transcript(s): H61775_T22 (SEQ ID NO: 2). Table 12 below describes the starting and ending position of this segment on each transcript.

TABLE 12

Segment location on transcripts

| Transcript name | Segment starting position | Segment ending position |
|---|---|---|
| H61775_T22 (SEQ ID NO: 2) | 515 | 715 |

Segment cluster H61775_node_8 (SEQ ID NO: 6) according to the present invention is supported by 5 libraries. The number of libraries was determined as previously described. This segment can be found in the following transcript(s): H61775_T21 (SEQ ID NO: 1). Table 13 below describes the starting and ending position of this segment on each transcript.

TABLE 13

Segment location on transcripts

| Transcript name | Segment starting position | Segment ending position |
|---|---|---|
| H61775_T21 (SEQ ID NO: 1) | 508 | 1205 |

According to an optional embodiment of the present invention, short segments related to the above cluster are also provided. These segments are up to about 120 bp in length, and so are included in a separate description.

Segment cluster H61775_node_0 (SEQ ID NO: 7) according to the present invention is supported by 4 libraries. The number of libraries was determined as previously described. This segment can be found in the following transcript(s): H61775_T21 (SEQ ID NO: 1) and H61775_T22 (SEQ ID NO: 2). Table 14 below describes the starting and ending position of this segment on each transcript.

TABLE 14

Segment location on transcripts

| Transcript name | Segment starting position | Segment ending position |
|---|---|---|
| H61775_T21 (SEQ ID NO: 1) | 1 | 86 |
| H61775_T22 (SEQ ID NO: 2) | 1 | 86 |

Segment cluster H61775_node_5 (SEQ ID NO: 8) according to the present invention can be found in the following transcript(s): H61775_T22 (SEQ ID NO: 2). Table 15 below describes the starting and ending position of this segment on each transcript.

TABLE 15

Segment location on transcripts

| Transcript name | Segment starting position | Segment ending position |
|---|---|---|
| H61775_T22 (SEQ ID NO:2) | 508 | 514 |

Variant protein alignment to the previously known protein:

Sequence name: /tmp/Psw0RJLCti/aLAXQjXh07:Q9P2J2 (SEQ ID NO: 953)

Sequence Documentation:

Alignment of: H61775_P16 (SEQ ID NO: 9) x Q9P2J2 (SEQ ID NO: 953) . . .

Alignment segment 1/1:

Quality: 803.00

Escore: 0

Matching length: 83 Total length: 83

Matching Percent Similarity: 100.00 Matching Percent

Identity: 100.00

Total Percent Similarity: 100.00 Total Percent

Identity: 100.00

Gaps: 0

Alignment:

```
  1 MVWCLGLAVLSLVISQGADGRGKPEVVSVVGRAGESVVLGCDLLPPAGRP  50
    ||||||||||||||||||||||||||||||||||||||||||||||||||
 11 MVWCLGLAVLSLVISQGADGRGKPEVVSVVGRAGESVVLGCDLLPPAGRP  60

51 PLHVIEWLRFGFLLPIFIQFGLYSPRIDPDYVG                   83
    ||||||||||||||||||||||||||||||||
 61 PLHVIEWLRFGFLLPIFIQFGLYSPRIDPDYVG                   93
```

Sequence name: /tmp/Psw0RJLCti/aLAXQjXh07: AAQ88495 (SEQ ID NO: 954)

Sequence documentation:

Alignment of: H61775_P16 (SEQ ID NO: 9) x AAQ88495 (SEQ ID NO: 954)

Alignment segment 1/1:
  Quality: 803.00

Escore: 0
  Matching length: 83 Total length: 83
Matching Percent Similarity: 100.00 Matching Percent Identity: 100.00
  Total Percent Similarity: 100.00 Total Percent Identity: 100.00
    Gaps: 0
Alignment:

Identity: 100.00
  Total Percent Similarity: 100.00 Total Percent

Identity: 100.00

Gaps: 0

Alignment:

```
  1 MVWCLGLAVLSLVISQGADGRGKPEVVSVVGRAGESVVLGCDLLPPAGRP  50
    ||||||||||||||||||||||||||||||||||||||||||||||||||
 11 MVWCLGLAVLSLVISQGADGRGKPEVVSVVGRAGESVVLGCDLLPPAGRP  60

51 PLHVIEWLRFGFLLPIFIQFGLYSPRIDPDYVG                   83
    ||||||||||||||||||||||||||||||||
 61 PLHVIEWLRFGFLLPIFIQFGLYSPRIDPDYVG                   93
```

Sequence name: /tmp/naab8yR3GC/pSM4l2IL5o: AAQ88495 (SEQ ID NO: 954)

Sequence documentation:

Alignment of: H61775_P17 (SEQ ID NO: 10) x AAQ88495 (SEQ ID NO: 954) . . .

Alignment segment 1/1:
  Quality: 803.00

```
  1 MVWCLGLAVLSLVISQGADGRGKPEVVSVVGRAGESVVLGCDLLPPAGRP  50
    ||||||||||||||||||||||||||||||||||||||||||||||||||
  1 MVWCLGLAVLSLVISQGADGRGKPEVVSVVGRAGESVVLGCDLLPPAGRP  50

51 PLHVIEWLRFGFLLPIFIQFGLYSPRIDPDYVG                   83
    ||||||||||||||||||||||||||||||||
 51 PLHVIEWLRFGFLLPIFIQFGLYSPRIDPDYVG                   83
```

Sequence name: /tmp/naab8yR3GC/pSM4l2IL5o:Q9P2J2 (SEQ ID NO: 953)

Sequence documentation:

Alignment of: H61775_P17 (SEQ ID NO: 10) x Q9P2J2 (SEQ ID NO: 953) . . .

Alignment segment 1/1:
  Quality: 803.00

Escore: 0
  Matching length: 83 Total length: 83

Matching Percent Similarity: 100.00 Matching Percent

Identity: 100.00
  Total Percent Similarity: 100.00 Total Percent

Identity: 100.00

Gaps: 0

Alignment:

```
1   MVWCLGLAVLSLVISQGADGRGKPEVVSVVGRAGESVVLGCDLLPPAGRP   50
    ||||||||||||||||||||||||||||||||||||||||||||||||||
1   MVWCLGLAVLSLVISQGADGRGKPEVVSVVGRAGESVVLGCDLLPPAGRP   50

51  PLHVIEWLRFGFLLPIFIQFGLYSPRIDPDYVG                    83
    ||||||||||||||||||||||||||||||||
51  PLHVIEWLRFGFLLPIFIQFGLYSPRIDPDYVG                    83
```

Expression of immunoglobulin superfamily, member 9 H61775 transcripts which are detectable by amplicon as depicted in sequence name H61775seg8 (SEQ ID NO:957) in normal and cancerous ovary tissues.

Expression of immunoglobulin superfamily, member 9 transcripts detectable by or according to H61775seg8 (SEQ ID NO:957), H61775seg8 (SEQ ID NO:957) amplicon(s) and H61775seg8F2 (SEQ ID NO:955) and H61775seg8R2 (SEQ ID NO:956) primers was measured by real time PCR. In parallel the expression of four housekeeping genes: PBGD (GenBank Accession No. BC019323, (SEQ ID NO:1036); amplicon—PBGD-amplicon, (SEQ ID NO:1039)), HPRT1 (GenBank Accession No. NM_000194, (SEQ ID NO:1040); amplicon—HPRT1-amplicon, (SEQ ID NO:1043)), and SDHA (GenBank Accession No. NM_004168, (SEQ ID NO:1032); amplicon—SDHA-amplicon, (SEQ ID NO:1035)), GAPDH (GenBank Accession No. BC026907, (SEQ ID NO:1044); GAPDH amplicon, (SEQ ID NO:1047)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45-48, 71, Table 1, "Tissue samples in testing panel"), to obtain a value of fold up-regulation for each sample relative to median of the normal PM samples.

FIG. 7 is a histogram showing over expression of the above-indicated immunoglobulin superfamily, member 9 transcripts in cancerous ovary samples relative to the normal samples. (Values represent the average of duplicate experiments. Error bars indicate the minimal and maximal values obtained As is evident from FIG. 7, the expression of immunoglobulin superfamily, member 9 transcripts detectable by the above amplicon(s) in cancer samples was significantly higher than in the non-cancerous samples (Sample Nos. 45-48, 71 Table 1, "Tissue samples in testing panel") and including benign samples (samples No. 56, 62, 64). Notably an over-expression of at least 5 fold was found in 21 out of 43 adenocarcinoma samples.

Statistical analysis was applied to verify the significance of these results, as described below.

The P value for the difference in the expression levels of immunoglobulin superfamily, member 9 transcripts detectable by the above amplicon(s) in ovary cancer samples versus the normal tissue samples was determined by T test as 2.76E-4.

The above value demonstrates statistical significance of the results.

Primer pairs are also optionally and preferably encompassed within the present invention; for example, for the above experiment, the following primer pair was used as a non-limiting illustrative example only of a suitable primer pair: H61775seg8F2 (SEQ ID NO:955) forward primer; and H61775seg8R2 (SEQ ID NO:956) reverse primer.

The present invention also preferably encompasses any amplicon obtained through the use of any suitable primer pair; for example, for the above experiment, the following amplicon was obtained as a non-limiting illustrative example only of a suitable amplicon: H61775seg8 (SEQ ID NO:957)

H61775seg8F2 (SEQ ID NO:955)

GAAGGCTCTTGTCACTTACTAGCCAT

H61775seg8R2 (SEQ ID NO:956)

TGTCACCATATTTAATCCTCCCAA

Amplicon (SEQ ID NO:957)

GAAGGCTCTTGTCACTTACTAGCCATGT-
GATTTTGGAAAGAAACTTAACATTAATTC
CTTCAGCTACAATGGAATTCTTGGGAG-
GATTAAATATGGTGACA

Expression of immunoglobulin superfamily, member 9H61775 transcripts which are detectable by amplicon as depicted in sequence name H61775seg8 (SEQ ID NO:957) in different normal tissues.

Expression of immunoglobulin superfamily, member 9 transcripts detectable by or according to H61775 seg8 amplicon(s) and H61775 seg8F and H61775 seg8R was measured by real time PCR. In parallel the expression of four housekeeping genes—RPL19 (GenBank Accession No. NM_000981, (SEQ ID NO:1048); RPL19 amplicon, (SEQ ID NO:1051)), TATA box (GenBank Accession No. NM_003194, (SEQ ID NO:1052); TATA amplicon, (SEQ ID NO:1055)), Ubiquitin (GenBank Accession No. BC000449, (SEQ ID NO:1056); amplicon—Ubiquitin-amplicon, (SEQ ID NO: 1059)) and SDHA (GenBank Accession No. NM_004168, (SEQ ID NO: 1032); amplicon—SDHA-amplicon, (SEQ ID NO: 1035)) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 2 "Tissue samples in normal panel", above), to obtain a value of relative expression of each sample relative to median of the ovary samples.

Figure 8:
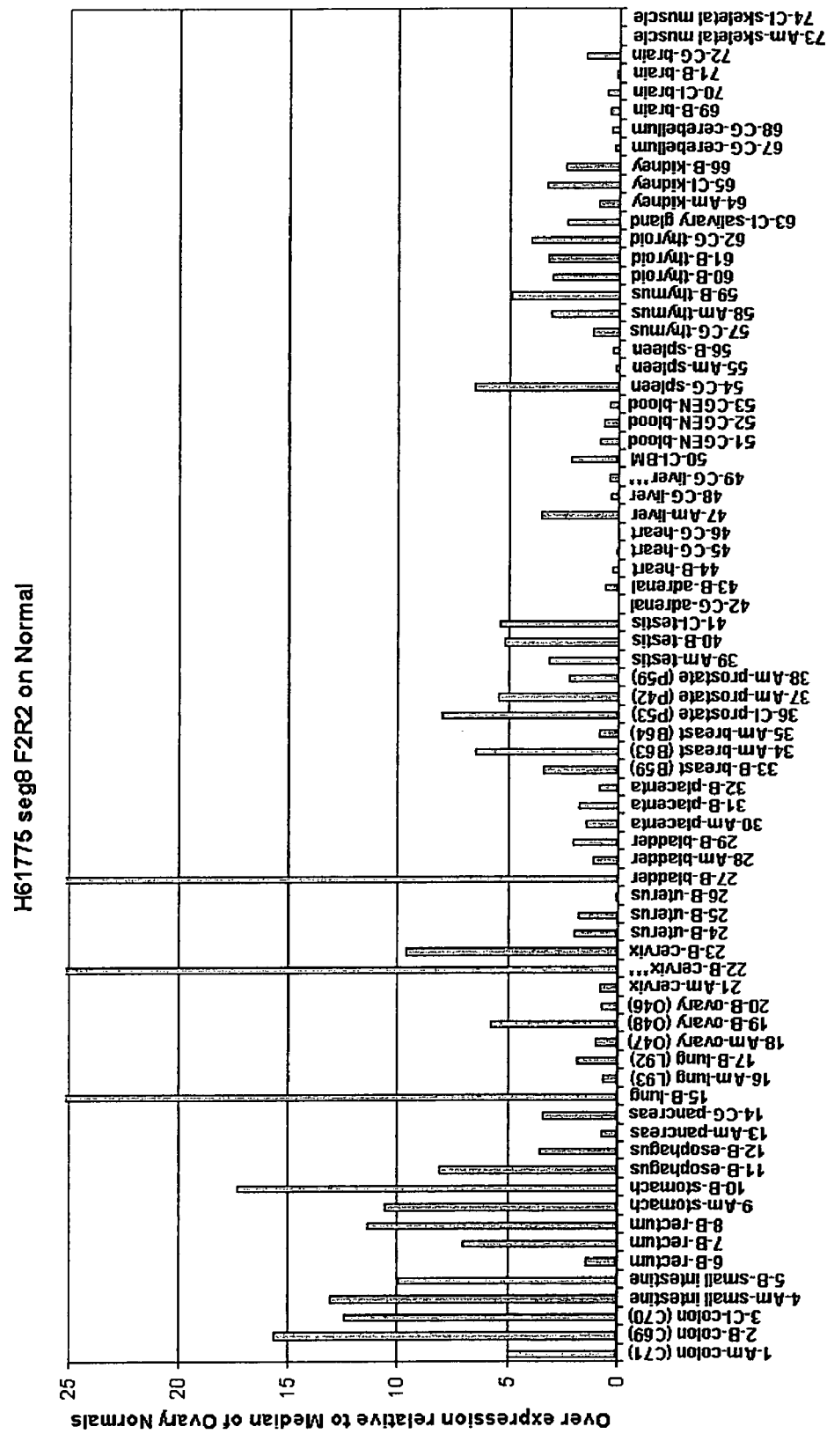
FIG. 8 shows expression of segment8 in H61775 in normal tissues.

The results are described in FIG. 8, presenting the histogram showing the expression of H61775 transcripts which are detectable by amplicon as depicted in sequence name H61775seg8 (SEQ ID NO:957), in different normal tissues. Amplicon and primers are as above.

DESCRIPTION FOR CLUSTER HSAPHOL

Cluster HSAPHOL features 7 transcript(s) and 18 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| HSAPHOL_T10 | 11 |
| HSAPHOL_T4 | 12 |
| HSAPHOL_T5 | 13 |
| HSAPHOL_T6 | 14 |
| HSAPHOL_T7 | 15 |
| HSAPHOL_T8 | 16 |
| HSAPHOL_T9 | 17 |

TABLE 2

Segments of interest

| Segment Name | SEQ ID NO: |
|---|---|
| HSAPHOL_node_11 | 18 |
| HSAPHOL_node_13 | 19 |
| HSAPHOL_node_15 | 20 |
| HSAPHOL_node_19 | 21 |
| HSAPHOL_node_2 | 22 |
| HSAPHOL_node_21 | 23 |
| HSAPHOL_node_23 | 24 |
| HSAPHOL_node_26 | 25 |
| HSAPHOL_node_28 | 26 |
| HSAPHOL_node_38 | 27 |
| HSAPHOL_node_40 | 28 |
| HSAPHOL_node_42 | 29 |
| HSAPHOL_node_16 | 30 |
| HSAPHOL_node_25 | 31 |
| HSAPHOL_node_34 | 32 |
| HSAPHOL_node_35 | 33 |
| HSAPHOL_node_36 | 34 |
| HSAPHOL_node_41 | 35 |

TABLE 3

Proteins of interest

| Protein Name | SEQ ID NO: |
|---|---|
| HSAPHOL_P2 | 37 |
| HSAPHOL_P3 | 38 |
| HSAPHOL_P4 | 39 |
| HSAPHOL_P5 | 40 |
| HSAPHOL_P6 | 41 |
| HSAPHOL_P7 | 42 |
| HSAPHOL_P8 | 43 |

These sequences are variants of the known protein Alkaline phosphatase, tissue-nonspecific isozyme precursor (SwissProt accession identifier PPBT_HUMAN; known also according to the synonyms EC 3.1.3.1; AP-TNAP; Liver/bone/kidney isozyme; TNSALP), SEQ ID NO: 36, referred to herein as the previously known protein.

The variant proteins according to the present invention are variant(s) of a known diagnostic marker, called Alkaline Phosphatase.

Protein Alkaline phosphatase, tissue-nonspecific isozyme precursor is known or believed to have the following function(s): THIS ISOZYME MAY PLAY A ROLE IN SKELETAL MINERALIZATION. The sequence for protein Alkaline phosphatase, tissue-nonspecific isozyme precursor is given at the end of the application, as "Alkaline phosphatase, tissue-nonspecific isozyme precursor amino acid sequence". Known polymorphisms for this sequence are as shown in Table 4.

TABLE 4

Amino acid mutations for Known Protein

| SNP position(s) on amino acid sequence | Comment |
|---|---|
| 28 | Y -> C (in hypophosphatasia; infantile; 7% of activity)./FTId = VAR_013972. |
| 33 | A -> V (in hypophosphatasia)./FTId = VAR_006147. |
| 111 | A -> T (in hypophosphatasia; odonto)./FTId = VAR_006151. |
| 116 | A -> T (in hypophosphatasia; loss of activity)./FTId = VAR_013977. |
| 120 | G -> R (in hypophosphatasia)./FTId = VAR_013978. |
| 129 | G -> R (in hypophosphatasia)./FTId = VAR_013979. |
| 132 | A -> V (in hypophosphatasia)./FTId = VAR_013146. |
| 134 | T -> N (in hypophosphatasia; 9% of activity)./FTId = VAR_011082. |
| 136 | R -> H (in hypophosphatasia; moderate; 33% of activity)./FTId = VAR_006152. |
| 152 | R -> H (in hypophosphatasia)./FTId = VAR_013980. |
| 162 | G -> V (in hypophosphatasia; severe; 1% of activity)./FTId = VAR_006153. |
| 170 | N -> D (in hypophosphatasia)./FTId = VAR_013981. |
| 40 | A -> V (in hypophosphatasia; 2% of activity)./FTId = VAR_011081. |
| 171 | H -> Y (in hypophosphatasia; severe; 2% of activity)./FTId = VAR_006154. |
| 176 | A -> T (in hypophosphatasia)./FTId = VAR_011083. |
| 177 | A -> T (in hypophosphatasia; adult type)./FTId = VAR_006155. |
| 179 | A -> T (in hypophosphatasia)./FTId = VAR_006156. |
| 181 | S -> L (in hypophosphatasia; 1% OF activity)./FTId = VAR_013982. |
| 184 | R -> W (in hypophosphatasia; loss of activity)./FTId = VAR_013983. |
| 191 | E -> G (in hypophosphatasia; odonto)./FTId = VAR_006157. |
| 191 | E -> K (in hypophosphatasia; moderate; frequent mutation in European countries)./FTId = VAR_006158. |
| 201 | C -> Y (in hypophosphatasia)./FTId = VAR_006159. |
| 207 | Q -> P (in hypophosphatasia)./FTId = VAR_006160. |
| 51 | A -> V (in hypophosphatasia)./FTId = VAR_013973. |
| 211 | N -> D (in hypophosphatasia)./FTId = VAR_013984. |
| 220 | G -> V (in hypophosphatasia; odonto)./FTId = VAR_013985. |
| 223 | R -> W (in hypophosphatasia; 3% of activity)./FTId = VAR_013986. |
| 224 | K -> E (in hypophosphatasia; infantile; partial loss of activity)./FTId = VAR_011084. |
| 235 | E -> G (in hypophosphatasia)./FTId = VAR_013987. |
| 246 | R -> S (in hypophosphatasia; 4% of activity)./FTId = VAR_011085. |
| 249 | G -> V (in hypophosphatasia; partial loss of activity)./FTId = VAR_013988. |
| 263 | H -> Y (common polymorphism)./FTId = VAR_006161. |
| 289 | L -> F (in hypophosphatasia)./FTId = VAR_006162. |
| 291 | E -> K (in hypophosphatasia; moderate; 8% of activity)./FTId = VAR_013989. |
| 62 | M -> L (in hypophosphatasia; moderate; 27% of activity)./FTId = VAR_006148. |
| 294 | D -> A (in hypophosphatasia)./FTId = VAR_006163. |
| 294 | D -> Y (in hypophosphatasia)./FTId = VAR_013990. |
| 306 | D -> V (in hypophosphatasia)./FTId = VAR_006164. |
| 326 | G -> R (in hypophosphatasia; in a patient carrying also lys-291)./FTId = VAR_013991. |
| 327 | F -> G (in hypophosphatasia; requires 2 nucleotides substitutions)./FTId = VAR_013992. |
| 327 | F -> L (in hypophosphatasia; childhood)./FTId = VAR_006165. |
| 334 | G -> D (in hypophosphatasia)./FTId = VAR_006166. |
| 348 | A -> T (in hypophosphatasia)./FTId = VAR_011086. |
| 378 | D -> V (in hypophosphatasia; loss of activity)./FTId = VAR_006167. |
| 381 | H -> R (in hypophosphatasia)./FTId = VAR_011087. |
| 63 | G -> V (in hypophosphatasia; loss of activity)./FTId = VAR_013974. |

TABLE 4-continued

Amino acid mutations for Known Protein

SNP
position(s)
on
amino acid
sequence   Comment

| 382 | V -> I (in hypophosphatasia)./FTId = VAR_006168. |
| 391 | R -> C (in hypophosphatasia; moderate; 10% of activity)./FTId = VAR_013993. |
| 399 | A -> S (in hypophosphatasia)./FTId = VAR_013994. |
| 406 | D -> G (in hypophosphatasia; 15% of activity)./FTId = VAR_011088. |
| 423 | V -> A (in hypophosphatasia; 16% of activity)./FTId = VAR_013995. |
| 426 | G -> C (in hypophosphatasia; infantile; partial loss of activity)./FTId = VAR_011089. |
| 436 | Y -> H (in hypophosphatasia)./FTId = VAR_006169. |
| 445 | S -> P (in hypophosphatasia; severe; 2% of activity)./FTId = VAR_013996. |
| 450 | R -> C (in hypophosphatasia; severe; 4% of activity)./FTId = VAR_013997. |
| 450 | R -> H (in hypophosphatasia)./FTId = VAR_011090. |
| 71  | R -> C (in hypophosphatasia)./FTId = VAR_006149. |
| 456 | G -> R (in hypophosphatasia; loss of activity)./FTId = VAR_011091. |
| 459 | V -> M (in hypophosphatasia; infantile)./FTId = VAR_013998. |
| 473 | G -> S (in hypophosphatasia)./FTId = VAR_013999. |
| 476 | E -> K (in hypophosphatasia)./FTId = VAR_006170. |
| 478 | N -> I (in hypophosphatasia; 9% of activity)./FTId = VAR_011092. |
| 489 | C -> S (in hypophosphatasia; 9% of activity)./FTId = VAR_011093. |
| 490 | I -> F (in hypophosphatasia; odonto; partial loss of activity)./FTId = VAR_014000. |
| 491 | G -> R (in hypophosphatasia)./FTId = VAR_014001. |
| 522 | V -> A./FTId = VAR_011094. |
| 29  | W -> A |
| 71  | R -> H (in hypophosphatasia)./FTId = VAR_013975. |
| 104 | N -> K |
| 71  | R -> P (in hypophosphatasia)./FTId = VAR_006150. |
| 75  | G -> S (in hypophosphatasia; severe; 3.5% of activity)./FTId = VAR_013976. |

Protein Alkaline phosphatase, tissue-nonspecific isozyme precursor localization is believed to be attached to the membrane by a GPI-anchor.

The following GO Annotation(s) apply to the previously known protein. The following annotation(s) were found: skeletal development; ossification; metabolism, which are annotation(s) related to Biological Process; magnesium binding; alkaline phosphatase; hydrolase, which are annotation(s) related to Molecular Function; and integral membrane protein, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLinkl>.

As noted above, cluster HSAPHOL features 7 transcript(s), which were listed in Table 1 above. These transcript(s) encode for protein(s) which are variant(s) of protein Alkaline phosphatase, tissue-nonspecific isozyme precursor. A description of each variant protein according to the present invention is now provided.

Variant protein HSAPHOL_P2 (SEQ ID NO: 37) according to the present invention has an amino acid sequence as given at the end of the application; it is encoded by transcript(s) HSAPHOL_T4 (SEQ ID NO: 12). An alignment is given to the known protein (Alkaline phosphatase, tissue-nonspecific isozyme precursor) at the end of the application. One or more alignments to one or more previously published protein sequences are given at the end of the application. A brief description of the relationship of the variant protein according to the present invention to each such aligned protein is as follows:

Comparison report between HSAPHOL_P2 (SEQ ID NO: 37) and AAH21289 (SEQ ID NO: 36):

1. An isolated chimeric polypeptide encoding for HSAPHOL_P2 (SEQ ID NO: 37), comprising a first amino acid sequence being at least 70%, optionally at least 80%, preferably at least 85%, more preferably at least 90% and most preferably at least 95% homologous to a polypeptide having the sequence PHSGPAAAFIRRRGWWPGPRCA (SEQ ID NO: 1111) corresponding to amino acids 1-22 of HSAPHOL_P2 (SEQ ID NO: 37), second amino acid sequence being at least 90% homologous to PATPRPLSWLRAPTRLCLDGPSPVLCA corresponding to amino acids 1-27 of AAH21289, which also corresponds to amino acids 23-49 of HSAPHOL_P2 (SEQ ID NO: 37), and a third amino acid sequence being at least 90% homologous to EKEKDPKYWRDQAQETLKYALELQKLNTNVAKNVIM-FLGDGMGVSTVTAARILKGQL HHNPGEETRLEMDKFPFVALSKTYNTNAQVPDSAGTATAYLCGVKANEGT VGVSAAT ERSRCNTTQGNEVTSILRWAKDAGKSV-GIVTTTRVNHATPSAAYAHSADRDWYSDNE MPPEALSQGCKDIAYQLMHNIRDID-VIMGGGRKYMYPKNKTDVEYESDEKARGTRLD GLDLVDTWKSFKPRYKHSHFIWNR-TELLTLDPHNVDYLLGLFEPGDMQYELNRNNVT DPSLSEMVVVAIQILRKNPKGFFLLVEG-GRIDHGHHEGKAKQALHEAVEMDRAIGQAG SLTSSEDTLTVVTADHSHVFTFGGYT-PRGNSIFGLAPMLSDTDKKPFTAILYGNGPGYK VVG-GERENVSMVDYAHNNYQAQSAVPL-RHETHGGEDVAVFSKGPMAHLLHGVHEQN YVPHVMAYAACIGANLGHCAPASSAGS-LAAGPLLLALALYPLSVLF corresponding to amino acids 83-586 of AAH21289, which also corresponds to amino acids 50-553 of HSAPHOL_P2 (SEQ ID NO: 37), wherein said first, second and third amino acid sequences are contiguous and in a sequential order.

2. An isolated polypeptide encoding for a head of HSAPHOL_P2 (SEQ ID NO: 37), comprising a polypeptide being at least 70%, optionally at least about 80%, preferably at least about 85%, more preferably at least about 90% and most preferably at least about 95% homologous to the sequence PHSGPAAAFIRRRGWWPGPRCA (SEQ ID NO: 1111) of HSAPHOL_P2 (SEQ ID NO: 37).

3. An isolated chimeric polypeptide encoding for an edge portion of HSAPHOL_P2 (SEQ ID NO: 37), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AE, having a structure as follows: a sequence starting from any of amino acid numbers 49−x to 49; and ending at any of amino acid numbers 50+((n−2)−x), in which x varies from 0 to n−2.

Comparison report between HSAPHOL_P2 (SEQ ID NO: 37) and PPBT_HUMAN:

1. An isolated chimeric polypeptide encoding for HSAPHOL_P2 (SEQ ID NO: 37), comprising a first amino acid sequence being at least 70%, optionally at least 80%, preferably at least 85%, more preferably at least 90% and most preferably at least 95% homologous to a polypeptide having the sequence PHSGPAAAFIRRRGWWPGPRCAPAT-PRPLSWLRAPTRLCLDGPSPVLCA corresponding to amino acids 1-49 of HSAPHOL_P2 (SEQ ID NO: 37), second amino acid sequence being at least 90% homologous to EKEKDPKYWRDQAQETLKYALELQKLNT-NVAKNVIMFLGDGMGVSTVTAARILKGQL HHNP-GEETRLEMDKFPFVALSKTYNTNAQVPD-SAGTATAYLCGVKANEGTVGVSAAT ERSRCNTTQGNEVTSILRWAKDAGKSV-GIVTTTRVNHATPSAAYAHSADRDWYSDNE MPPEALSQGCKDIAYQLMHNIRDID-VIMGGGRKYMYPKNKTDVEYESDEKARGTRLD GLDLVDTWKSFKPRYKHSHFIWNR-TELLTLDPHNVDYLLGLFEPGDMQYELNRNNVT DPSLSEMVVVAIQILRKNPKGFFLLVEG-GRIDHGHHEGKAKQALHEAVEMDRAIGQAG SLTSSEDTLTVVTADHSHVFTFGGYT-PRGNSIFGLAPMLSDTDKKPFTAILYGNGPGYK VVG-GERENVSMVDYAHNNYQAQSAVPL-RHETHGGEDVAVFSKGPMAHLLHGVHEQN YVPHVMAYAACIGANLGHCAPASSAGS-LAAGPLLLALALYPLSVLF corresponding to amino acids 21-524 of PPBT_HUMAN, which also corresponds to amino acids 50-553 of HSAPHOL_P2 (SEQ ID NO: 37), wherein said first, second and third amino acid sequences are contiguous and in a sequential order.

2. An isolated polypeptide encoding for a head of HSAPHOL_P2 (SEQ ID NO: 37), comprising a polypeptide being at least 70%, optionally at least about 80%, preferably at least about 85%, more preferably at least about 90% and most preferably at least about 95% homologous to the sequence PHSGPAAAFIRRRGWWPGPRCAPAT-PRPLSWLRAPTRLCLDGPSPVLCA of HSAPHOL_P2 (SEQ ID NO: 37).

3. An isolated chimeric polypeptide encoding for an edge portion of HSAPHOL_P2 (SEQ ID NO: 37), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AE, having a structure as follows: a sequence starting from any of amino acid numbers 49−x to 49; and ending at any of amino acid numbers 50+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region, and similarity to known proteins suggests a GPI anchor. Variant protein HSAPHOL_P2 (SEQ ID NO: 37) also has the following non-silent SNPs (Single Nucleotide Polymorphisms) as listed in Table 5, (given according to their position(s) on the amino acid sequence, with the alternative amino acid(s) listed; the last column indicates whether the SNP is known or not; the presence of known SNPs in variant protein HSAPHOL_P2 (SEQ ID NO: 37) sequence provides support for the deduced sequence of this variant protein according to the present invention).

TABLE 5

Amino acid mutations

| SNP position(s) on amino acid sequence | Alternative amino acid(s) | Previously known SNP? |
|---|---|---|
| 153 | N -> S | Yes |
| 172 | Q -> | No |
| 551 | V -> A | No |
| 206 | A -> | No |
| 272 | R -> | No |
| 292 | Y -> H | Yes |
| 342 | V -> | No |
| 344 | V -> | No |
| 354 | K -> | No |
| 354 | K -> Q | No |
| 380 | E -> | No |

Variant protein HSAPHOL_P2 (SEQ ID NO: 37) is encoded by the following transcript(s): HSAPHOL_T4 (SEQ ID NO: 12), for which the sequence(s) is/are given at the end of the application. The coding portion of transcript HSAPHOL_T4 (SEQ ID NO: 12) is shown in bold; this coding portion starts at position 1 and ends at position 1659. The transcript also has the following SNPs as listed in Table 6 (given according to their position on the nucleotide sequence, with the alternative nucleic acid listed; the last column indicates whether the SNP is known or not; the presence of known SNPs in variant protein HSAPHOL_P2 (SEQ ID NO: 37) sequence provides support for the deduced sequence of this variant protein according to the present invention).

TABLE 6

Nucleic acid SNPs

| SNP position on nucleotide sequence | Alternative nucleic acid | Previously known SNP? |
|---|---|---|
| 417 | C -> T | Yes |
| 458 | A -> G | Yes |
| 1140 | G -> | No |
| 1509 | C -> T | Yes |
| 1629 | G -> T | Yes |
| 1652 | T -> C | No |
| 1727 | C -> T | Yes |
| 1788 | G -> A | Yes |
| 1895 | A -> C | Yes |
| 2050 | C -> T | Yes |
| 2095 | A -> G | Yes |
| 2240 | G -> | No |
| 516 | G -> | No |
| 2347 | -> A | No |
| 2364 | T -> G | No |
| 617 | C -> | No |
| 815 | G -> | No |
| 874 | T -> C | Yes |
| 1026 | G -> | No |
| 1032 | G -> | No |
| 1060 | A -> | No |
| 1060 | A -> C | No |

Variant protein HSAPHOL_P3 (SEQ ID NO: 38) according to the present invention has an amino acid sequence as given at the end of the application; it is encoded by transcript(s) HSAPHOL_T5 (SEQ ID NO: 13). An alignment is given to the known protein (Alkaline phosphatase, tissue-nonspecific isozyme precursor) at the end of the application. One or more alignments to one or more previously published protein sequences are given at the end of the application. A brief description of the relationship of the variant protein according to the present invention to each such aligned protein is as follows:

Comparison report between HSAPHOL_P3 (SEQ ID NO: 38) and AAH21289:

1. An isolated chimeric polypeptide encoding for HSAPHOL_P3 (SEQ ID NO: 38), comprising a first amino acid sequence being at least 90% homologous to MISPFLVLAIGTCLTNSLVP corresponding to amino acids 63-82 of AAH21289, which also corresponds to amino acids 1-20 of HSAPHOL_P3 (SEQ ID NO: 38), and a second amino acid sequence being at least 90% homologous to GMGVSTVTAARILKGQLHHNPGEETRLEMDKFPFVALSKTYNTNAQVPDSAGTATAYL CGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTD VEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSV LF corresponding to amino acids 123-586 of AAH21289, which also corresponds to amino acids 21-484 of HSAPHOL_P3 (SEQ ID NO: 38), wherein said first and second amino acid sequences are contiguous and in a sequential order.

2. An isolated chimeric polypeptide encoding for an edge portion of HSAPHOL_P3 (SEQ ID NO: 38), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PG, having a structure as follows: a sequence starting from any of amino acid numbers 20−x to 20; and ending at any of amino acid numbers 21+((n−2)−x), in which x varies from 0 to n−2.

Comparison report between HSAPHOL_P3 (SEQ ID NO: 38) and PPBT_HUMAN:

1. An isolated chimeric polypeptide encoding for HSAPHOL_P3 (SEQ ID NO: 38), comprising a first amino acid sequence being at least 90% homologous to MISPFLVLAIGTCLTNSLVP corresponding to amino acids 1-20 of PPBT_HUMAN, which also corresponds to amino acids 1-20 of HSAPHOL_P3 (SEQ ID NO: 38), and a second amino acid sequence being at least 90% homologous to GMGVSTVTAARILKGQLHHNPGEETRLEMDKFPFVALSKTYNTNAQVPDSAGTATAYL CGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTD VEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSV LF corresponding to amino acids 61-524 of PPBT_HUMAN, which also corresponds to amino acids 21-484 of HSAPHOL_P3 (SEQ ID NO: 38), wherein said first and second amino acid sequences are contiguous and in a sequential order.

2. An isolated chimeric polypeptide encoding for an edge portion of HSAPHOL_P3 (SEQ ID NO: 38), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PG, having a structure as follows: a sequence starting from any of amino acid numbers 20−x to 20; and ending at any of amino acid numbers 21+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because of manual inspection of known protein localization and/or gene structure, and/or similarity to known proteins.

Variant protein HSAPHOL_P3 (SEQ ID NO: 38) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein HSAPHOL_P3 (SEQ ID NO: 38) sequence provides support for the deduced sequence of this variant protein according to the present invention).

TABLE 7

Amino acid mutations

| SNP position(s) on amino acid sequence | Alternative amino acid(s) | Previously known SNP? |
|---|---|---|
| 103 | Q -> | No |
| 137 | A -> | No |
| 84 | N -> S | Yes |
| 10 | I -> | No |
| 203 | R -> | No |
| 223 | Y -> H | Yes |
| 273 | V -> | No |
| 275 | V -> | No |
| 285 | K -> | No |
| 285 | K -> Q | No |
| 311 | E -> | No |
| 482 | V -> A | No |

Variant protein HSAPHOL_P3 (SEQ ID NO: 38) is encoded by the following transcript(s): HSAPHOL_T5 (SEQ ID NO: 13), for which the sequence(s) is/are given at the end of the application. The coding portion of transcript HSAPHOL_T5 (SEQ ID NO: 13) is shown in bold; this coding portion starts at position 253 and ends at position 1704. The transcript also has the following SNPs as listed in Table 8 (given according to their position on the nucleotide sequence, with the alternative nucleic acid listed; the last column indicates whether the SNP is known or not; the presence of known SNPs in variant protein HSAPHOL_P3 (SEQ ID NO: 38) sequence provides support for the deduced sequence of this variant protein according to the present invention).

TABLE 8

Nucleic acid SNPs

| SNP position on nucleotide sequence | Alternative nucleic acid | Previously known SNP? |
|---|---|---|
| 179 | G -> C | No |
| 231 | A -> | No |
| 1071 | G -> | No |
| 1077 | G -> | No |
| 1105 | A -> | No |
| 1105 | A -> C | No |
| 1185 | G -> | No |
| 1554 | C -> T | Yes |
| 1674 | G -> T | Yes |
| 1697 | T -> C | No |
| 1772 | C -> T | Yes |
| 1833 | G -> A | Yes |
| 232 | A -> T | No |
| 1940 | A -> C | Yes |
| 2095 | C -> T | Yes |
| 2140 | A -> G | Yes |
| 2285 | G -> | No |
| 2392 | -> A | No |
| 2409 | T -> G | No |
| 281 | T -> | No |
| 462 | C -> T | Yes |
| 503 | A -> G | Yes |
| 561 | G -> | No |
| 662 | C -> | No |
| 860 | G -> | No |
| 919 | T -> C | Yes |

Variant protein HSAPHOL_P4 (SEQ ID NO: 39) according to the present invention has an amino acid sequence as given at the end of the application; it is encoded by transcript(s) HSAPHOL_T6 (SEQ ID NO: 14). An alignment is given to the known protein (Alkaline phosphatase, tissue-nonspecific isozyme precursor) at the end of the application. One or more alignments to one or more previously published protein sequences are given at the end of the application. A brief description of the relationship of the variant protein according to the present invention to each such aligned protein is as follows:

Comparison report between HSAPHOL_P4 (SEQ ID NO: 39) and AAH21289:

1. An isolated chimeric polypeptide encoding for HSAPHOL_P4 (SEQ ID NO: 39), comprising a first amino acid sequence being at least 90% homologous to MGVSTVTAARILKGQLHHNPGEETRLEM-
DKFPFVALSKTYNTNAQVPDSAGTATAYLC
GVKANEGTVGVSAATERSRCNT-
TQGNEVTSILRWAKDAGKSVGIVTTTRVNHATPSAA
YAHSADRDWYSDNEMPPEALSQGCKDI-
AYQLMHNIRDIDVIMGGGRKYMYPKNKTDV EYES-
DEKARGTRLDGLDLVDTWKSFKPRYKHS-
HFIWNRTELLTLDPHNVDYLLGLFEP
GDMQYELNRNNVTDPSLSEMVVVAIQIL-
RKNPKGFFLLVEGGRIDHGHHEGKAKQALH EAVEM-
DRAIGQAGSLTSSEDTLTVVTADHSH-
VFTFGGYTPRGNSIFGLAPMLSDTDKKP
FTAILYGNGPGYKVVGGERENVSM-
VDYAHNNYQAQSAVPLRHETHGGEDVAVFSKGP
MAHLLHGVHEQNYVPHVMAYAACIGAN-
LGHCAPASSAGSLAAGPLLLALALYPLSVL F corresponding to amino acids 124-586 of AAH21289, which also corresponds to amino acids 1-463 of HSAPHOL_P4 (SEQ ID NO: 39).

Comparison report between HSAPHOL_P4 (SEQ ID NO: 39) and PPBT_HUMAN:

1. An isolated chimeric polypeptide encoding for HSAPHOL_P4 (SEQ ID NO: 39), comprising a first amino acid sequence being at least 90% homologous to MGVSTVTAARILKGQLHHNPGEETRLEM-
DKFPFVALSKTYNTNAQVPDSAGTATAYLC
GVKANEGTVGVSAATERSRCNT-
TQGNEVTSILRWAKDAGKSVGIVTTTRVNHATPSAA
YAHSADRDWYSDNEMPPEALSQGCKDI-
AYQLMHNIRDIDVIMGGGRKYMYPKNKTDV EYES-
DEKARGTRLDGLDLVDTWKSFKPRYKHS-
HFIWNRTELLTLDPHNVDYLLGLFEP
GDMQYELNRNNVTDPSLSEMVVVAIQIL-
RKNPKGFFLLVEGGRIDHGHHEGKAKQALH EAVEM-
DRAIGQAGSLTSSEDTLTVVTADHSH-
VFTFGGYTPRGNSIFGLAPMLSDTDKKP
FTAILYGNGPGYKVVGGERENVSM-
VDYAHNNYQAQSAVPLRHETHGGEDVAVFSKGP
MAHLLHGVHEQNYVPHVMAYAACIGAN-
LGHCAPASSAGSLAAGPLLLALALYPLSVL F corresponding to amino acids 62-524 of PPBT_HUMAN, which also corresponds to amino acids 1-463 of HSAPHOL_P4 (SEQ ID NO: 39).

The location of the variant protein was determined according to results from a number of different software programs and analyses, including analyses from SignalP and other specialized programs. The variant protein is believed to be located as follows with regard to the cell: membrane. The protein localization is believed to be membrane because only one of the two trans-membrane region prediction programs (Tmpred: 1, Tmhmm: 0) has predicted that this protein has a trans-membrane region, but similarity to known proteins suggests a GPI anchor. In addition both signal-peptide prediction programs predict that this protein is a non-secreted protein.

Variant protein HSAPHOL_P4 (SEQ ID NO: 39) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein HSAPHOL_P4 (SEQ ID NO: 39) sequence provides support for the deduced sequence of this variant protein according to the present invention).

TABLE 9

Amino acid mutations

| SNP position(s) on amino acid sequence | Alternative amino acid(s) | Previously known SNP? |
|---|---|---|
| 116 | A -> | No |
| 182 | R -> | No |
| 82 | Q -> | No |
| 202 | Y -> H | Yes |
| 252 | V -> | No |
| 254 | V -> | No |
| 264 | K -> | No |
| 264 | K -> Q | No |
| 290 | E -> | No |
| 461 | V -> A | No |
| 63 | N -> S | Yes |

Variant protein HSAPHOL_P4 (SEQ ID NO: 39) is encoded by the following transcript(s): HSAPHOL_T6 (SEQ ID NO: 14), for which the sequence(s) is/are given at the end of the application. The coding portion of transcript HSAPHOL_T6 (SEQ ID NO: 14) is shown in bold; this coding portion starts at position 215 and ends at position 1603. The transcript also has the following SNPs as listed in Table 10 (given according to their position on the nucleotide sequence, with the alternative nucleic acid listed; the last column indicates whether the SNP is known or not; the presence of known SNPs in variant protein HSAPHOL_P4 (SEQ ID NO: 39) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 361 | C -> T | Yes |
| 402 | A -> G | Yes |
| 1084 | G -> | No |
| 1453 | C -> T | Yes |
| 1573 | G -> T | Yes |
| 1596 | T -> C | No |
| 1671 | C -> T | Yes |
| 1732 | G -> A | Yes |
| 1839 | A -> C | Yes |
| 1994 | C -> T | Yes |
| 2039 | A -> G | Yes |
| 2184 | G -> | No |
| 460 | G -> | No |
| 2291 | -> A | No |
| 2308 | T -> G | No |
| 561 | C -> | No |
| 759 | G -> | No |
| 818 | T -> C | Yes |
| 970 | G -> | No |
| 976 | G -> | No |
| 1004 | A -> | No |
| 1004 | A -> C | No |

Variant protein HSAPHOL_P5 (SEQ ID NO: 40) according to the present invention has an amino acid sequence as given at the end of the application; it is encoded by transcript(s) HSAPHOL_T7 (SEQ ID NO: 15). An alignment is given to the known protein (Alkaline phosphatase, tissue-nonspecific isozyme precursor) at the end of the application. One or more alignments to one or more previously published protein sequences are given at the end of the application. A brief description of the relationship of the variant protein according to the present invention to each such aligned protein is as follows:

Comparison report between HSAPHOL_P5 (SEQ ID NO: 40) and AAH21289:

1. An isolated chimeric polypeptide encoding for HSAPHOL_P5 (SEQ ID NO: 40), comprising a first amino acid sequence being at least 90% homologous to MISPFLVLAIGTCLTNSLVPEKEKDPKY-WRDQAQETLKYALELQKLNTNVAKNVIMFL GDGMGVSTVTAARILKGQLHHNPGEETRLEMDKFPFVAL SKTYNTNAQVPDSAGTAT AYLCGV-KANEGTVGVSAATERSRCNT-TQGNEVTSILRWAKDAGKSVGIVTTTRVNHA TPSAAYAHSADRDWYSDNEMP-PEALSQGCKDIAYQLMHNIRDIDVIMGGGRKYMYPK NKTDVEYESDEKARGTRLDGLD-LVDTWKSFKPRYKHSHFIWNRTELLTLDPHNVDYLL GLFEPGDMQYELNRNNVTDPSLSEMV-VVAIQILRKNPKGFFLLVEGGRIDHGHHEGKA KQAL-HEAVEM corresponding to amino acids 63-417 of AAH21289, which also corresponds to amino acids 1-355 of HSAPHOL_P5 (SEQ ID NO: 40), and a second amino acid sequence being at least 90% homologous to DHSHVFTFG-GYTPRGNSIFGLAPMLSDTDKKPFTAI-LYGNGPGYKVVGGERENVSMVD YAHNNYQAQSAV-PLRHETHGGEDVAVFSKGPMAHLLHGVHEQNYVPH VMAYAACIG ANLGHCAPASSAGSLAAGPLLLALALY-PLSVLF corresponding to amino acids 440-586 of AAH21289, which also corresponds to amino acids 356-502 of HSAPHOL_P5 (SEQ ID NO: 40), wherein said first and second amino acid sequences are contiguous and in a sequential order.

2. An isolated chimeric polypeptide encoding for an edge portion of HSAPHOL_P5 (SEQ ID NO: 40), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise MD, having a structure as follows: a sequence starting from any of amino acid numbers 355−x to 355; and ending at any of amino acid numbers 356+((n−2)−x), in which x varies from 0 to n−2.

Comparison report between HSAPHOL_P5 (SEQ ID NO: 40) and PPBT_HUMAN:

1. An isolated chimeric polypeptide encoding for HSAPHOL_P5 (SEQ ID NO: 40), comprising a first amino acid sequence being at least 90% homologous to MISPFLVLAIGTCLTNSLVPEKEKDPKY-WRDQAQETLKYALELQKLNTNVAKNVIMFL GDGMGVSTVTAARILKGQLHHNPGEETRLEMDKFPFVAL SKTYNTNAQVPDSAGTAT AYLCGV-KANEGTVGVSAATERSRCNT-TQGNEVTSILRWAKDAGKSVGIVTTTRVNHA TPSAAYAHSADRDWYSDNEMP-PEALSQGCKDIAYQLMHNIRDIDVIMGGGRKYMYPK NKTDVEYESDEKARGTRLDGLD-LVDTWKSFKPRYKHSHFIWNRTELLTLDPHNVDYLL GLFEPGDMQYELNRNNVTDPSLSEMV-VVAIQILRKNPKGFFLLVEGGRIDHGHHEGKA KQAL-HEAVEM corresponding to amino acids 1-355 of PPBT_HUMAN, which also corresponds to amino acids 1-355 of HSAPHOL_P5 (SEQ ID NO: 40), and a second amino acid sequence being at least 90% homologous to DHS-HVFTFGGYTPRGNSIFGLAPMLSDTD-KKPFTAILYGNGPGYKVVGGERENVSMVD YAHNNYQAQSAVPLRHETHGGEDVAVF-SKGPMAHLLHGVHEQNYVPHVMAYAACIG ANLGH-CAPASSAGSLAAGPLLLALALYPLSVLF corresponding to amino acids 377-524 of PPBT_HUMAN, which also corresponds to amino acids 356-502 of HSAPHOL_P5 (SEQ ID NO: 40), wherein said first and second amino acid sequences are contiguous and in a sequential order.

2. An isolated chimeric polypeptide encoding for an edge portion of HSAPHOL_P5 (SEQ ID NO: 40), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise MD, having a structure as follows: a sequence starting from any of amino acid numbers 355−x to 355; and ending at any of amino acid numbers 356+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because of manual inspection of known protein localization and/or gene structure and/or similarity to known protein.

Variant protein HSAPHOL_P5 (SEQ ID NO: 40) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein HSAPHOL_P5 (SEQ ID NO: 40) sequence provides support for the deduced sequence of this variant protein according to the present invention).

TABLE 11

Amino acid mutations

| SNP position(s) on amino acid sequence | Alternative amino acid(s) | Previously known SNP? |
| --- | --- | --- |
| 124 | N -> S | Yes |
| 143 | Q -> | No |
| 500 | V -> A | No |
| 10 | I -> | No |
| 177 | A -> | No |
| 243 | R -> | No |
| 263 | Y -> H | Yes |
| 313 | V -> | No |
| 315 | V -> | No |
| 325 | K -> | No |
| 325 | K -> Q | No |
| 351 | E -> | No |

Variant protein HSAPHOL_P5 (SEQ ID NO: 40) is encoded by the following transcript(s): HSAPHOL_T7 (SEQ ID NO: 15), for which the sequence(s) is/are given at the end of the application. The coding portion of transcript HSAPHOL_T7 (SEQ ID NO: 15) is shown in bold; this coding portion starts at position 253 and ends at position 1758. The transcript also has the following SNPs as listed in Table 12 (given according to their position on the nucleotide sequence, with the alternative nucleic acid listed; the last column indicates whether the SNP is known or not; the presence of known SNPs in variant protein HSAPHOL_P5 (SEQ ID NO: 40) sequence provides support for the deduced sequence of this variant protein according to the present invention).

TABLE 12

Nucleic acid SNPs

| SNP position on nucleotide sequence | Alternative nucleic acid | Previously known SNP? |
| --- | --- | --- |
| 179 | G -> C | No |
| 231 | A -> | No |
| 1191 | G -> | No |
| 1197 | G -> | No |
| 1225 | A -> | No |
| 1225 | A -> C | No |
| 1305 | G -> | No |
| 1608 | C -> T | Yes |
| 1728 | G -> T | Yes |
| 1751 | T -> C | No |
| 1826 | C -> T | Yes |
| 1887 | G -> A | Yes |
| 232 | A -> T | No |
| 1994 | A -> C | Yes |
| 2149 | C -> T | Yes |
| 2194 | A -> G | Yes |
| 2339 | G -> | No |
| 2446 | -> A | No |
| 2463 | T -> G | No |
| 281 | T -> | No |
| 582 | C -> T | Yes |
| 623 | A -> G | Yes |
| 681 | G -> | No |
| 782 | C -> | No |

TABLE 12-continued

Nucleic acid SNPs

| SNP position on nucleotide sequence | Alternative nucleic acid | Previously known SNP? |
| --- | --- | --- |
| 980 | G -> | No |
| 1039 | T -> C | Yes |

Variant protein HSAPHOL_P6 (SEQ ID NO: 41) according to the present invention has an amino acid sequence as given at the end of the application; it is encoded by transcript(s) HSAPHOL_T8 (SEQ ID NO: 16). An alignment is given to the known protein (Alkaline phosphatase, tissue-nonspecific isozyme precursor) at the end of the application. One or more alignments to one or more previously published protein sequences are given at the end of the application. A brief description of the relationship of the variant protein according to the present invention to each such aligned protein is as follows:

Comparison report between HSAPHOL_P6 (SEQ ID NO: 41) and AAH21289:

1. An isolated chimeric polypeptide encoding for HSAPHOL_P6 (SEQ ID NO: 41), comprising a first amino acid sequence being at least 90% homologous to MISPFLVLAIGTCLTNSLVPEKEKDPKY-WRDQAQETLKYALELQKLNTNVAKNVIMFL GDGMGVSTVTAARILKGQLHHNPGEETRLEMDKFPFVAL SKTYNTNAQVPDSAGTAT AYLCGV-KANEGTVGVSAATERSRCNT-TQGNEVTSILRWAKDAGKSVGIVTTTRVNHA TPSAAYAHSADRDWYSDNEMP-PEALSQGCKDIAYQLMHNIRDIDVIMGGGRKYMYPK NKTDVEYESDEKARGTRLDGLD-LVDTWKSFKPRYKHSHFIWNRTELLTLDPHNVDYLL corresponding to amino acids 63-349 of AAH21289, which also corresponds to amino acids 1-287 of HSAPHOL_P6 (SEQ ID NO: 41), and a second amino acid sequence being at least 90% homologous to GGRIDHGHHEGKAKQAL-HEAVEMDRAIGQAGSLTSSEDTLTV-VTADHSHVFTFGGYTP RGNSIFGLAPMLSDTD-KKPFTAILYGNGPGYKVVGGERENVSMVDYAHNNY QAQSAV PLRHETHGGEDVAVFSKGPMAHLLH-GVHEQNYVPHVMAYAACIGANLGHCAPASSAG SLAAGPLLLALALYPLSVLF corresponding to amino acids 395-586 of AAH21289, which also corresponds to amino acids 288-479 of HSAPHOL_P6 (SEQ ID NO: 41), wherein said first and second amino acid sequences are contiguous and in a sequential order.

2. An isolated chimeric polypeptide encoding for an edge portion of HSAPHOL_P6 (SEQ ID NO: 41), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 287−x to 287; and ending at any of amino acid numbers 288+((n−2)−x), in which x varies from 0 to n−2.

Comparison report between HSAPHOL_P6 (SEQ ID NO: 41) and PPBT_HUMAN:

1. An isolated chimeric polypeptide encoding for HSAPHOL_P6 (SEQ ID NO: 41), comprising a first amino acid sequence being at least 90% homologous to MISPFLVLAIGTCLTNSLVPEKEKDPKY- WRDQAQETLKYALELQKLNTNVAKNVIMFL GDG-
MGVSTVTAARILKGQLHHNPGEETRLEMDKFPFVAL
SKTYNTNAQVPDSAGTAT AYLCGV-
KANEGTVGVSAATERSRCNT-
TQGNEVTSILRWAKDAGKSVGIVTTTRVNHA
TPSAAYAHSADRDWYSDNEMP-
PEALSQGCKDIAYQLMHNIRDIDVIMGGGRKYMYPK
NKTDVEYESDEKARGTRLDGLD-
LVDTWKSFKPRYKHSHFIWNRTELLTLDPHNVDYLL
corresponding to amino acids 1-287 of PPBT_HUMAN, which also corresponds to amino acids 1-287 of HSA-PHOL_P6 (SEQ ID NO: 41), and a second amino acid sequence being at least 90% homologous to GGRIDHGH-HEGKAKQALHEAVEMD-
RAIGQAGSLTSSEDTLTVVTADHSHVFTFGGYTP
RGNSIFGLAPMLSDTDKKPFTAILYGNG-
PGYKVVGGERENVSMVDYAHNNYQAQSAV
PLRHETHGGEDVAVFSKGPMAHLLH-
GVHEQNYVPHVMAYAACIGANLGHCAPASSAG
SLAAGPLLLALALYPLSVLF corresponding to amino acids 333-524 of PPBT_HUMAN, which also corresponds to amino acids 288-479 of HSAPHOL_P6 (SEQ ID NO: 41), wherein said first and second amino acid sequences are contiguous and in a sequential order.

2. An isolated chimeric polypeptide encoding for an edge portion of HSAPHOL_P6 (SEQ ID NO: 41), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 287−x to 287; and ending at any of amino acid numbers 288+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because both signal-peptide prediction programs predict that this protein has a signal peptide, and at least one of two trans-membrane region prediction programs predicts that this protein has a trans-membrane region, also similarity to known proteins suggests a GPI anchor.

Variant protein HSAPHOL_P6 (SEQ ID NO: 41) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein HSAPHOL_P6 (SEQ ID NO: 41) sequence provides support for the deduced sequence of this variant protein according to the present invention).

TABLE 13

Amino acid mutations

| SNP position(s) on amino acid sequence | Alternative amino acid(s) | Previously known SNP? |
|---|---|---|
| 124 | N −> S | Yes |
| 143 | Q −> | No |
| 177 | A −> | No |
| 243 | R −> | No |
| 263 | Y −> H | Yes |

TABLE 13-continued

Amino acid mutations

| SNP position(s) on amino acid sequence | Alternative amino acid(s) | Previously known SNP? |
|---|---|---|
| 306 | E −> | No |
| 477 | V −> A | No |
| 10 | I −> | No |

Variant protein HSAPHOL_P6 (SEQ ID NO: 41) is encoded by the following transcript(s): HSAPHOL_T8 (SEQ ID NO: 16), for which the sequence(s) is/are given at the end of the application. The coding portion of transcript HSAPHOL_T8 (SEQ ID NO: 16) is shown in bold; this coding portion starts at position 253 and ends at position 1689. The transcript also has the following SNPs as listed in Table 14 (given according to their position on the nucleotide sequence, with the alternative nucleic acid listed; the last column indicates whether the SNP is known or not; the presence of known SNPs in variant protein HSAPHOL_P6 (SEQ ID NO: 41) sequence provides support for the deduced sequence of this variant protein according to the present invention).

TABLE 14

Nucleic acid SNPs

| SNP position on nucleotide sequence | Alternative nucleic acid | Previously known SNP? |
|---|---|---|
| 179 | G −> C | No |
| 231 | A −> | No |
| 1170 | G −> | No |
| 1539 | C −> T | Yes |
| 1659 | G −> T | Yes |
| 1682 | T −> C | No |
| 1757 | C −> T | Yes |
| 1818 | G −> A | Yes |
| 1925 | A −> C | Yes |
| 2080 | C −> T | Yes |
| 2125 | A −> G | Yes |
| 2270 | G −> | No |
| 232 | A −> T | No |
| 2377 | −> A | No |
| 2394 | T −> G | No |
| 281 | T −> | No |
| 582 | C −> T | Yes |
| 623 | A −> G | Yes |
| 681 | G −> | No |
| 782 | C −> | No |
| 980 | G −> | No |
| 1039 | T −> C | Yes |

Variant protein HSAPHOL_P7 (SEQ ID NO: 42) according to the present invention has an amino acid sequence as given at the end of the application; it is encoded by transcript(s) HSAPHOL_T9 (SEQ ID NO: 17). An alignment is given to the known protein (Alkaline phosphatase, tissue-nonspecific isozyme precursor) at the end of the application. One or more alignments to one or more previously published protein sequences are given at the end of the application. A brief description of the relationship of the variant protein according to the present invention to each such aligned protein is as follows:

Comparison report between HSAPHOL_P7 (SEQ ID NO: 42) and AAH21289:

1. An isolated chimeric polypeptide encoding for HSAPHOL_P7 (SEQ ID NO: 42), comprising a first amino acid sequence being at least 90% homologous to MISPFLV-LAIGTCLTNSLVPEKEKDPKY- WRDQAQETLKYALELQKLNTNVAKNVIMFL GDG-MGVSTVTAARILKGQLHHNPGEETRLEMDKFPFVAL SKTYNTNAQVPDSAGTAT AYLCGV-KANEGTVGVSAATERSRCNT-TQGNEVTSILRWAKDAGKSVGIVTTTRVNHA TPSAAYAHSADRDWYSDNEMP-PEALSQGCKDIAYQLMHNIRDIDVIMGGGRKYMYPK NKTDVEYESDEKARGTRLDGLDLVDTWKSFKPRYK corresponding to amino acids 63-326 of AAH21289, which also corresponds to amino acids 1-264 of HSAPHOL_P7 (SEQ ID NO: 42), and a second amino acid sequence being at least 70%, optionally at least 80%, preferably at least 85%, more preferably at least 90% and most preferably at least 95% homologous to a polypeptide having the sequence LPPRC-PLANRVDFSWAGREYRLQTFSKPLIFLANVFLQTQRP (SEQ ID NO: 1112) corresponding to amino acids 265-306 of HSAPHOL_P7 (SEQ ID NO: 42), wherein said first and second amino acid sequences are contiguous and in a sequential order.

2. An isolated polypeptide encoding for a tail of HSA-PHOL_P7 (SEQ ID NO: 42), comprising a polypeptide being at least 70%, optionally at least about 80%, preferably at least about 85%, more preferably at least about 90% and most preferably at least about 95% homologous to the sequence LPPRCPLANRVDFSWAGREYRLQTFSKP-LIFLANVFLQTQRP (SEQ ID NO: 1112) in HSAPHOL_P7 (SEQ ID NO: 42).

Comparison report between HSAPHOL_P7 (SEQ ID NO: 42) and PPBT_HUMAN:

1. An isolated chimeric polypeptide encoding for HSA-PHOL_P7 (SEQ ID NO: 42), comprising a first amino acid sequence being at least 90% homologous to MISPFLV-LAIGTCLTNSLVPEKEKDPKY-WRDQAQETLKYALELQKLNTNVAKNVIMFL GDG-MGVSTVTAARILKGQLHHNPGEETRLEMDKFPFVAL SKTYNTNAQVPDSAGTAT AYLCGV-KANEGTVGVSAATERSRCNT-TQGNEVTSILRWAKDAGKSVGIVTTTRVNHA TPSAAYAHSADRDWYSDNEMP-PEALSQGCKDIAYQLMHNIRDIDVIMGGGRKYMYPK NKTDVEYESDEKARGTRLDGLDLVDTWKSFKPR corresponding to amino acids 1-262 of PPBT_HUMAN, which also corresponds to amino acids 1-262 of HSAPHOL_P7 (SEQ ID NO: 42), and a second amino acid sequence being at least 70%, optionally at least 80%, preferably at least 85%, more preferably at least 90% and most preferably at least 95% homologous to a polypeptide having the sequence YKLP-PRCPLANRVDFSWAGREYRLQTF-SKPLIFLANVFLQTQRP corresponding to amino acids 263-306 of HSAPHOL_P7 (SEQ ID NO: 42), wherein said first and second amino acid sequences are contiguous and in a sequential order.

2. An isolated polypeptide encoding for a tail of HSA-PHOL_P7 (SEQ ID NO: 42), comprising a polypeptide being at least 70%, optionally at least about 80%, preferably at least about 85%, more preferably at least about 90% and most preferably at least about 95% homologous to the sequence YKLPPRCPLANRVDFSWAGREYRLQTF-SKPLIFLANVFLQTQRP in HSAPHOL_P7 (SEQ ID NO: 42).

Comparison report between HSAPHOL_P7 (SEQ ID NO: 42) and O75090 (SEQ ID NO: 958):

1. An isolated chimeric polypeptide encoding for HSA-PHOL_P7 (SEQ ID NO: 42), comprising a first amino acid sequence being at least 90% homologous to MISPFLV-LAIGTCLTNSLVPEKEKDPKY-WRDQAQETLKYALELQKLNTNVAKNVIMFL GDG-MGVSTVTAARILKGQLHHNPGEETRLEMDKFPFVAL SKTYNTNAQVPDSAGTAT AYLCGV-KANEGTVGVSAATERSRCNT-TQGNEVTSILRWAKDAGKSVGIVTTTRVNHA TPSAAYAHSADRDWYSDNEMP-PEALSQGCKDIAYQLMHNIRDIDVIMGGGRKYMYPK NKTDVEYESDEKARGTRLDGLDLVDTWKSFKPRYK corresponding to amino acids 1-264 of O75090 (SEQ ID NO: 958), which also corresponds to amino acids 1-264 of HSA-PHOL_P7 (SEQ ID NO: 42), and a second amino acid sequence being at least 70%, optionally at least 80%, preferably at least 85%, more preferably at least 90% and most preferably at least 95% homologous to a polypeptide having the sequence LPPRCPLANRVDFSWAGREYRLQTFSKP-LIFLANVFLQTQRP corresponding to amino acids 265-306 of HSAPHOL_P7 (SEQ ID NO: 42), wherein said first and second amino acid sequences are contiguous and in a sequential order.

2. An isolated polypeptide encoding for a tail of HSA-PHOL_P7 (SEQ ID NO: 42), comprising a polypeptide being at least 70%, optionally at least about 80%, preferably at least about 85%, more preferably at least about 90% and most preferably at least about 95% homologous to the sequence LPPRCPLANRVDFSWAGREYRLQTFSKP-LIFLANVFLQTQRP (SEQ ID NO: 1112) in HSAPHOL_P7 (SEQ ID NO: 42).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSAPHOL_P7 (SEQ ID NO: 42) also has the following non-silent SNPs (Single Nucleotide Polymorphisms) as listed in Table 15, (given according to their position(s) on the amino acid sequence, with the alternative amino acid(s) listed; the last column indicates whether the SNP is known or not; the presence of known SNPs in variant protein HSAPHOL_P7 (SEQ ID NO: 42) sequence provides support for the deduced sequence of this variant protein according to the present invention).

TABLE 15

Amino acid mutations

| SNP position(s) on amino acid sequence | Alternative amino acid(s) | Previously known SNP? |
| --- | --- | --- |
| 124 | N -> S | Yes |
| 143 | Q -> | No |
| 177 | A -> | No |
| 243 | R -> | No |
| 263 | Y -> H | Yes |
| 273 | N -> T | Yes |
| 10 | I -> | No |

Variant protein HSAPHOL_P7 (SEQ ID NO: 42) is encoded by the following transcript(s): HSAPHOL_T9 (SEQ ID NO: 17), for which the sequence(s) is/are given at the end of the application. The coding portion of transcript HSA-PHOL_T9 (SEQ ID NO: 17) is shown in bold; this coding portion starts at position 253 and ends at position 1170. The transcript also has the following SNPs as listed in Table 16 (given according to their position on the nucleotide sequence, with the alternative nucleic acid listed; the last column indicates whether the SNP is known or not; the presence of known SNPs in variant protein HSAPHOL_P7 (SEQ ID NO: 42) sequence provides support for the deduced sequence of this variant protein according to the present invention).

TABLE 16

Nucleic acid SNPs

| SNP position on nucleotide sequence | Alternative nucleic acid | Previously known SNP? |
|---|---|---|
| 179 | G –> C | No |
| 231 | A –> | No |
| 1070 | A –> C | Yes |
| 1225 | C –> T | Yes |
| 1270 | A –> G | Yes |
| 1415 | G –> | No |
| 1522 | –> A | No |
| 1539 | T –> G | No |
| 232 | A –> T | No |
| 281 | T –> | No |
| 582 | C –> T | Yes |
| 623 | A –> G | Yes |
| 681 | G –> | No |
| 782 | C –> | No |
| 980 | G –> | No |
| 1039 | T –> C | Yes |

Variant protein HSAPHOL_P8 (SEQ ID NO: 43) according to the present invention has an amino acid sequence as given at the end of the application; it is encoded by transcript(s) HSAPHOL_T10 (SEQ ID NO: 11). An alignment is given to the known protein (Alkaline phosphatase, tissue-nonspecific isozyme precursor) at the end of the application. One or more alignments to one or more previously published protein sequences are given at the end of the application. A brief description of the relationship of the variant protein according to the present invention to each such aligned protein is as follows:

Comparison report between HSAPHOL_P8 (SEQ ID NO: 43) and AAH21289:

1. An isolated chimeric polypeptide encoding for HSAPHOL_P8 (SEQ ID NO: 43), comprising a first amino acid sequence being at least 90% homologous to MISPFLVLAIGTCLTNSLVPEKEKDPKY-WRDQAQETLKYALELQKLNTNVAKNVIMFL GDG-MGVSTVTAARILKGQLHHNPGEETRLEMDKFPFVAL SKTYNTNAQVPDSAGTAT AYLCGV-KANEGTVGVSAATERSRCNT-TQGNEVTSILRWAKDAGKSVGIVTTTRVNHA TPSAAYAHSADRDWYSDNEMP-PEALSQGCKDIAYQLMHNIRDIDVIMGGGRKYMYPK NKTDVEYESDEKARGTRLDGLD-LVDTWKSFKPRYKHSHFIWNRTELLTLDPHNVDYLL G corresponding to amino acids 63-350 of AAH21289, which also corresponds to amino acids 1-288 of HSAPHOL_P8 (SEQ ID NO: 43), and a second amino acid sequence being at least 70%, optionally at least 80%, preferably at least 85%, more preferably at least 90% and most preferably at least 95% homologous to a polypeptide having the sequence KWRGWRGGCMARSLVAGAACGQHLGTRP (SEQ ID NO: 1113) corresponding to amino acids 289-316 of HSAPHOL_P8 (SEQ ID NO: 43), wherein said first and second amino acid sequences are contiguous and in a sequential order.

2. An isolated polypeptide encoding for a tail of HSAPHOL_P8 (SEQ ID NO: 43), comprising a polypeptide being at least 70%, optionally at least about 80%, preferably at least about 85%, more preferably at least about 90% and most preferably at least about 95% homologous to the sequence KWRGWRGGCMARSLVAGAACGQHLGTRP (SEQ ID NO: 1113) in HSAPHOL_P8 (SEQ ID NO: 43).

Comparison report between HSAPHOL_P8 (SEQ ID NO: 43) and PPBT_HUMAN:

1. An isolated chimeric polypeptide encoding for HSAPHOL_P8 (SEQ ID NO: 43), comprising a first amino acid sequence being at least 90% homologous to MISPFLVLAIGTCLTNSLVPEKEKDPKY-WRDQAQETLKYALELQKLNTNVAKNVIMFL GDG-MGVSTVTAARILKGQLHHNPGEETRLEMDKFPFVAL SKTYNTNAQVPDSAGTAT AYLCGV-KANEGTVGVSAATERSRCNT-TQGNEVTSILRWAKDAGKSVGIVTTTRVNHA TPSAAYAHSADRDWYSDNEMP-PEALSQGCKDIAYQLMHNIRDIDVIMGGGRKYMYPK NKTDVEYESDEKARGTRLDGLD-LVDTWKSFKPRYKHSHFIWNRTELLTLDPHNVDYLL G corresponding to amino acids 1-288 of PPBT_HUMAN, which also corresponds to amino acids 1-288 of HSAPHOL_P8 (SEQ ID NO: 43), and a second amino acid sequence being at least 70%, optionally at least 80%, preferably at least 85%, more preferably at least 90% and most preferably at least 95% homologous to a polypeptide having the sequence KWRGWRGGCMARSLVAGAACGQHLGTRP (SEQ ID NO: 1113) corresponding to amino acids 289-316 of HSAPHOL_P8 (SEQ ID NO: 43), wherein said first and second amino acid sequences are contiguous and in a sequential order.

2. An isolated polypeptide encoding for a tail of HSAPHOL_P8 (SEQ ID NO: 43), comprising a polypeptide being at least 70%, optionally at least about 80%, preferably at least about 85%, more preferably at least about 90% and most preferably at least about 95% homologous to the sequence KWRGWRGGCMARSLVAGAACGQHLGTRP (SEQ ID NO: 1113) in HSAPHOL_P8 (SEQ ID NO: 43).

Comparison report between HSAPHOL_P8 (SEQ ID NO: 43) and O75090 (SEQ ID NO: 958) (SEQ ID NO:958):

1. An isolated chimeric polypeptide encoding for HSAPHOL_P8 (SEQ ID NO: 43), comprising a first amino acid sequence being at least 90% homologous to MISPFLVLAIGTCLTNSLVPEKEKDPKY-WRDQAQETLKYALELQKLNTNVAKNVIMFL GDG-MGVSTVTAARILKGQLHHNPGEETRLEMDKFPFVAL SKTYNTNAQVPDSAGTAT AYLCGV-KANEGTVGVSAATERSRCNT-TQGNEVTSILRWAKDAGKSVGIVTTTRVNHA TPSAAYAHSADRDWYSDNEMP-PEALSQGCKDIAYQLMHNIRDIDVIMGGGRKYMYPK NKTDVEYESDEKARGTRLDGLD-LVDTWKSFKPRYKHSHFIWNRTELLTLDPHNVDYLL G corresponding to amino acids 1-288 of O75090 (SEQ ID NO: 958), which also corresponds to amino acids 1-288 of HSAPHOL_P8 (SEQ ID NO: 43), and a second amino acid sequence being at least 70%, optionally at least 80%, preferably at least 85%, more preferably at least 90% and most preferably at least 95% homologous to a polypeptide having the sequence KWRGWRGGCMARSLVAGAACGQHLGTRP (SEQ ID NO: 1113) corresponding to amino acids 289-316 of HSAPHOL_P8 (SEQ ID NO: 43), wherein said first and second amino acid sequences are contiguous and in a sequential order.

2. An isolated polypeptide encoding for a tail of HSAPHOL_P8 (SEQ ID NO: 43), comprising a polypeptide being at least 70%, optionally at least about 80%, preferably at least about 85%, more preferably at least about 90% and most preferably at least about 95% homologous to the sequence KWRGWRGGCMARSLVAGAACGQHLGTRP (SEQ ID NO: 1113) in HSAPHOL_P8 (SEQ ID NO: 43).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSAPHOL_P8 (SEQ ID NO: 43) also has the following non-silent SNPs (Single Nucleotide Polymorphisms) as listed in Table 17, (given according to their position(s) on the amino acid sequence, with the alternative amino acid(s) listed; the last column indicates whether the SNP is known or not; the presence of known SNPs in variant protein HSAPHOL_P8 (SEQ ID NO: 43) sequence provides support for the deduced sequence of this variant protein according to the present invention).

TABLE 17

Amino acid mutations

| SNP position(s) on amino acid sequence | Alternative amino acid(s) | Previously known SNP? |
|---|---|---|
| 124 | N –> S | Yes |
| 143 | Q –> | No |
| 177 | A –> | No |
| 243 | R –> | No |
| 263 | Y –> H | Yes |
| 294 | R –> S | Yes |
| 305 | G –> R | Yes |
| 307 | A –> V | Yes |
| 10 | I –> | No |

Variant protein HSAPHOL_P8 (SEQ ID NO: 43) is encoded by the following transcript(s): HSAPHOL_T10 (SEQ ID NO: 11), for which the sequence(s) is/are given at the end of the application. The coding portion of transcript HSAPHOL_T10 (SEQ ID NO: 11) is shown in bold; this coding portion starts at position 253 and ends at position 1200. The transcript also has the following SNPs as listed in Table 18 (given according to their position on the nucleotide sequence, with the alternative nucleic acid listed; the last column indicates whether the SNP is known or not; the presence of known SNPs in variant protein HSAPHOL_P8 (SEQ ID NO: 43) sequence provides support for the deduced sequence of this variant protein according to the present invention).

TABLE 18

Nucleic acid SNPs

| SNP position on nucleotide sequence | Alternative nucleic acid | Previously known SNP? |
|---|---|---|
| 179 | G –> C | No |
| 231 | A –> | No |
| 1134 | G –> T | Yes |
| 1165 | G –> A | Yes |
| 1172 | C –> T | Yes |
| 1376 | T –> C | Yes |
| 1384 | G –> C | Yes |
| 1565 | T –> G | Yes |
| 232 | A –> T | No |
| 281 | T –> | No |
| 582 | C –> T | Yes |

TABLE 18-continued

Nucleic acid SNPs

| SNP position on nucleotide sequence | Alternative nucleic acid | Previously known SNP? |
|---|---|---|
| 623 | A –> G | Yes |
| 681 | G –> | No |
| 782 | C –> | No |
| 980 | G –> | No |
| 1039 | T –> C | Yes |

As noted above, cluster HSAPHOL features 18 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSAPHOL_node_11 (SEQ ID NO: 18) according to the present invention is supported by 48 libraries. The number of libraries was determined as previously described. This segment can be found in the following transcript(s): HSAPHOL_T10 (SEQ ID NO: 11), HSAPHOL_T5 (SEQ ID NO: 13), HSAPHOL_T7 (SEQ ID NO: 15), HSAPHOL_T8 (SEQ ID NO: 16) and HSAPHOL_T9 (SEQ ID NO: 17). Table 19 below describes the starting and ending position of this segment on each transcript.

TABLE 19

Segment location on transcripts

| Transcript name | Segment starting position | Segment ending position |
|---|---|---|
| HSAPHOL_T10 (SEQ ID NO:11) | 149 | 313 |
| HSAPHOL_T5 (SEQ ID NO:13) | 149 | 313 |
| HSAPHOL_T7 (SEQ ID NO:15) | 149 | 313 |
| HSAPHOL_T8 (SEQ ID NO:16) | 149 | 313 |
| HSAPHOL_T9 (SEQ ID NO:17) | 149 | 313 |

Segment cluster HSAPHOL_node_13 (SEQ ID NO: 19) according to the present invention is supported by 50 libraries. The number of libraries was determined as previously described. This segment can be found in the following transcript(s): HSAPHOL_T10 (SEQ ID NO: 11), HSAPHOL_T4 (SEQ ID NO: 12), HSAPHOL_T7 (SEQ ID NO: 15), HSAPHOL_T8 (SEQ ID NO: 16) and HSAPHOL_T9 (SEQ ID NO: 17). Table 20 below describes the starting and ending position of this segment on each transcript.

TABLE 20

Segment location on transcripts

| Transcript name | Segment starting position | Segment ending position |
|---|---|---|
| HSAPHOL_T10 (SEQ ID NO:11) | 314 | 433 |
| HSAPHOL_T4 (SEQ ID NO:12) | 149 | 268 |
| HSAPHOL_T7 (SEQ ID NO:15) | 314 | 433 |

TABLE 20-continued

Segment location on transcripts

| Transcript name | Segment starting position | Segment ending position |
|---|---|---|
| HSAPHOL_T8 (SEQ ID NO:16) | 314 | 433 |
| HSAPHOL_T9 (SEQ ID NO:17) | 314 | 433 |

Segment cluster HSAPHOL_node_15 (SEQ ID NO: 20) according to the present invention is supported by 1 libraries. The number of libraries was determined as previously described. This segment can be found in the following transcript(s): HSAPHOL_T6 (SEQ ID NO: 14). Table 21 below describes the starting and ending position of this segment on each transcript.

TABLE 21

Segment location on transcripts

| Transcript name | Segment starting position | Segment ending position |
|---|---|---|
| HSAPHOL_T6 (SEQ ID NO:14) | 1 | 212 |

Segment cluster HSAPHOL_node_19 (SEQ ID NO: 21) according to the present invention is supported by 46 libraries. The number of libraries was determined as previously described. This segment can be found in the following transcript(s): HSAPHOL_T10 (SEQ ID NO: 11), HSAPHOL_T4 (SEQ ID NO: 12), HSAPHOL_T5 (SEQ ID NO: 13), HSAPHOL_T6 (SEQ ID NO: 14), HSAPHOL_T7 (SEQ ID NO: 15), HSAPHOL_T8 (SEQ ID NO: 16) and HSAPHOL_T9 (SEQ ID NO: 17). Table 22 below describes the starting and ending position of this segment on each transcript.

TABLE 22

Segment location on transcripts

| Transcript name | Segment starting position | Segment ending position |
|---|---|---|
| HSAPHOL_T10 (SEQ ID NO:11) | 550 | 724 |
| HSAPHOL_T4 (SEQ ID NO:12) | 385 | 559 |
| HSAPHOL_T5 (SEQ ID NO:13) | 430 | 604 |
| HSAPHOL_T6 (SEQ ID NO:14) | 329 | 503 |
| HSAPHOL_T7 (SEQ ID NO:15) | 550 | 724 |
| HSAPHOL_T8 (SEQ ID NO:16) | 550 | 724 |
| HSAPHOL_T9 (SEQ ID NO:17) | 550 | 724 |

Segment cluster HSAPHOL_node_2 (SEQ ID NO: 22) according to the present invention is supported by 33 libraries. The number of libraries was determined as previously described. This segment can be found in the following transcript(s): HSAPHOL_T10 (SEQ ID NO: 11), HSAPHOL_T4 (SEQ ID NO: 12), HSAPHOL_T5 (SEQ ID NO: 13), HSAPHOL_T7 (SEQ ID NO: 15), HSAPHOL_T8 (SEQ ID NO: 16) and HSAPHOL_T9 (SEQ ID NO: 17). Table 23 below describes the starting and ending position of this segment on each transcript.

TABLE 23

Segment location on transcripts

| Transcript name | Segment starting position | Segment ending position |
|---|---|---|
| HSAPHOL_T10 (SEQ ID NO:11) | 1 | 148 |
| HSAPHOL_T4 (SEQ ID NO:12) | 1 | 148 |
| HSAPHOL_T5 (SEQ ID NO:13) | 1 | 148 |
| HSAPHOL_T7 (SEQ ID NO:15) | 1 | 148 |
| HSAPHOL_T8 (SEQ ID NO:16) | 1 | 148 |
| HSAPHOL_T9 (SEQ ID NO:17) | 1 | 148 |

Segment cluster HSAPHOL_node_2 (SEQ ID NO: 22)1 according to the present invention is supported by 45 libraries. The number of libraries was determined as previously described. This segment can be found in the following transcript(s): HSAPHOL_T10 (SEQ ID NO: 11), HSAPHOL_T4 (SEQ ID NO: 12), HSAPHOL_T5 (SEQ ID NO: 13), HSAPHOL_T6 (SEQ ID NO: 14), HSAPHOL_T7 (SEQ ID NO: 15), HSAPHOL_T8 (SEQ ID NO: 16) and HSAPHOL_T9 (SEQ ID NO: 17). Table 24 below describes the starting and ending position of this segment on each transcript.

TABLE 24

Segment location on transcripts

| Transcript name | Segment starting position | Segment ending position |
|---|---|---|
| HSAPHOL_T10 (SEQ ID NO:11) | 725 | 900 |
| HSAPHOL_T4 (SEQ ID NO:12) | 560 | 735 |
| HSAPHOL_T5 (SEQ ID NO:13) | 605 | 780 |
| HSAPHOL_T6 (SEQ ID NO:14) | 504 | 679 |
| HSAPHOL_T7 (SEQ ID NO:15) | 725 | 900 |
| HSAPHOL_T8 (SEQ ID NO:16) | 725 | 900 |
| HSAPHOL_T9 (SEQ ID NO:17) | 725 | 900 |

Segment cluster HSAPHOL_node_2 (SEQ ID NO: 22)3 according to the present invention is supported by 45 libraries. The number of libraries was determined as previously described. This segment can be found in the following transcript(s): HSAPHOL_T10 (SEQ ID NO: 11), HSAPHOL_T4 (SEQ ID NO: 12), HSAPHOL_T5 (SEQ ID NO: 13), HSAPHOL_T6 (SEQ ID NO: 14), HSAPHOL_T7 (SEQ ID NO: 15), HSAPHOL_T8 (SEQ ID NO: 16) and HSAPHOL_T9 (SEQ ID NO: 17). Table 25 below describes the starting and ending position of this segment on each transcript.

TABLE 25

Segment location on transcripts

| Transcript name | Segment starting position | Segment ending position |
|---|---|---|
| HSAPHOL_T10 (SEQ ID NO:11) | 901 | 1044 |
| HSAPHOL_T4 (SEQ ID NO:12) | 736 | 879 |
| HSAPHOL_T5 (SEQ ID NO:13) | 781 | 924 |
| HSAPHOL_T6 (SEQ ID NO:14) | 680 | 823 |
| HSAPHOL_T7 (SEQ ID NO:15) | 901 | 1044 |
| HSAPHOL_T8 (SEQ ID NO:16) | 901 | 1044 |
| HSAPHOL_T9 (SEQ ID NO:17) | 901 | 1044 |

Segment cluster HSAPHOL_node_2 (SEQ ID NO: 22)6 according to the present invention is supported by 2 libraries. The number of libraries was determined as previously described. This segment can be found in the following transcript(s): HSAPHOL_T10 (SEQ ID NO: 11). Table 26 below describes the starting and ending position of this segment on each transcript.

TABLE 26

Segment location on transcripts

| Transcript name | Segment starting position | Segment ending position |
|---|---|---|
| HSAPHOL_T10 (SEQ ID NO:11) | 1115 | 1572 |

Segment cluster HSAPHOL_node_2 (SEQ ID NO: 22)8 according to the present invention is supported by 44 libraries. The number of libraries was determined as previously described. This segment can be found in the following transcript(s): HSAPHOL_T4 (SEQ ID NO: 12), HSAPHOL_T5 (SEQ ID NO: 13), HSAPHOL_T6 (SEQ ID NO: 14) and HSAPHOL_T7 (SEQ ID NO: 15). Table 27 below describes the starting and ending position of this segment on each transcript.

TABLE 27

Segment location on transcripts

| Transcript name | Segment starting position | Segment ending position |
|---|---|---|
| HSAPHOL_T4 (SEQ ID NO:12) | 950 | 1084 |
| HSAPHOL_T5 (SEQ ID NO:13) | 995 | 1129 |
| HSAPHOL_T6 (SEQ ID NO:14) | 894 | 1028 |
| HSAPHOL_T7 (SEQ ID NO:15) | 1115 | 1249 |

Segment cluster HSAPHOL_node_38 (SEQ ID NO: 27) according to the present invention is supported by 45 libraries. The number of libraries was determined as previously described. This segment can be found in the following transcript(s): HSAPHOL_T4 (SEQ ID NO: 12), HSAPHOL_T5 (SEQ ID NO: 13), HSAPHOL_T6 (SEQ ID NO: 14), HSAPHOL_T7 (SEQ ID NO: 15) and HSAPHOL_T8 (SEQ ID NO: 16). Table 28 below describes the starting and ending position of this segment on each transcript.

TABLE 28

Segment location on transcripts

| Transcript name | Segment starting position | Segment ending position |
|---|---|---|
| HSAPHOL_T4 (SEQ ID NO:12) | 1277 | 1396 |
| HSAPHOL_T5 (SEQ ID NO:13) | 1322 | 1441 |
| HSAPHOL_T6 (SEQ ID NO:14) | 1221 | 1340 |
| HSAPHOL_T7 (SEQ ID NO:15) | 1376 | 1495 |
| HSAPHOL_T8 (SEQ ID NO:16) | 1307 | 1426 |

Segment cluster HSAPHOL_node_40 (SEQ ID NO: 28) according to the present invention is supported by 69 libraries. The number of libraries was determined as previously described. This segment can be found in the following transcript(s): HSAPHOL_T4 (SEQ ID NO: 12), HSAPHOL_T5 (SEQ ID NO: 13), HSAPHOL_T6 (SEQ ID NO: 14), HSAPHOL_T7 (SEQ ID NO: 15) and HSAPHOL_T8 (SEQ ID NO: 16). Table 29 below describes the starting and ending position of this segment on each transcript.

TABLE 29

Segment location on transcripts

| Transcript name | Segment starting position | Segment ending position |
|---|---|---|
| HSAPHOL_T4 (SEQ ID NO:12) | 1397 | 1759 |
| HSAPHOL_T5 (SEQ ID NO:13) | 1442 | 1804 |
| HSAPHOL_T6 (SEQ ID NO:14) | 1341 | 1703 |
| HSAPHOL_T7 (SEQ ID NO:15) | 1496 | 1858 |
| HSAPHOL_T8 (SEQ ID NO:16) | 1427 | 1789 |

Segment cluster HSAPHOL_node_42 (SEQ ID NO: 29) according to the present invention is supported by 99 libraries. The number of libraries was determined as previously described. This segment can be found in the following transcript(s): HSAPHOL_T4 (SEQ ID NO: 12), HSAPHOL_T5 (SEQ ID NO: 13), HSAPHOL_T6 (SEQ ID NO: 14), HSAPHOL_T7 (SEQ ID NO: 15), HSAPHOL_T8 (SEQ ID NO: 16) and HSAPHOL_T9 (SEQ ID NO: 17). Table 30 below describes the starting and ending position of this segment on each transcript.

TABLE 30

Segment location on transcripts

| Transcript name | Segment starting position | Segment ending position |
|---|---|---|
| HSAPHOL_T4 (SEQ ID NO:12) | 1870 | 2426 |
| HSAPHOL_T5 (SEQ ID NO:13) | 1915 | 2471 |
| HSAPHOL_T6 (SEQ ID NO:14) | 1814 | 2370 |
| HSAPHOL_T7 | 1969 | 2525 |

TABLE 30-continued

Segment location on transcripts

| Transcript name | Segment starting position | Segment ending position |
|---|---|---|
| (SEQ ID NO:15) | | |
| HSAPHOL_T8 | 1900 | 2456 |
| (SEQ ID NO:16) | | |
| HSAPHOL_T9 | 1045 | 1601 |
| (SEQ ID NO:17) | | |

According to an optional embodiment of the present invention, short segments related to the above cluster are also provided. These segments are up to about 120 bp in length, and so are included in a separate description.

Segment cluster HSAPHOL_node__16 (SEQ ID NO: 30) according to the present invention is supported by 46 libraries. The number of libraries was determined as previously described. This segment can be found in the following transcript(s): HSAPHOL_T10 (SEQ ID NO: 11), HSAPHOL_T4 (SEQ ID NO: 12), HSAPHOL_T5 (SEQ ID NO: 13), HSAPHOL_T6 (SEQ ID NO: 14), HSAPHOL_T7 (SEQ ID NO: 15), HSAPHOL_T8 (SEQ ID NO: 16) and HSAPHOL_T9 (SEQ ID NO: 17). Table 31 below describes the starting and ending position of this segment on each transcript.

TABLE 31

Segment location on transcripts

| Transcript name | Segment starting position | Segment ending position |
|---|---|---|
| HSAPHOL_T10 | 434 | 549 |
| (SEQ ID NO:11) | | |
| HSAPHOL_T4 | 269 | 384 |
| (SEQ ID NO:12) | | |
| HSAPHOL_T5 | 314 | 429 |
| (SEQ ID NO:13) | | |
| HSAPHOL_T6 | 213 | 328 |
| (SEQ ID NO:14) | | |
| HSAPHOL_T7 | 434 | 549 |
| (SEQ ID NO:15) | | |
| HSAPHOL_T8 | 434 | 549 |
| (SEQ ID NO:16) | | |
| HSAPHOL_T9 | 434 | 549 |
| (SEQ ID NO:17) | | |

Segment cluster HSAPHOL_node__2 (SEQ ID NO: 22)5 according to the present invention is supported by 39 libraries. The number of libraries was determined as previously described. This segment can be found in the following transcript(s): HSAPHOL_T10 (SEQ ID NO: 11), HSAPHOL_T4 (SEQ ID NO: 12), HSAPHOL_T5 (SEQ ID NO: 13), HSAPHOL_T6 (SEQ ID NO: 14), HSAPHOL_T7 (SEQ ID NO: 15) and HSAPHOL_T8 (SEQ ID NO: 16). Table 32 below describes the starting and ending position of this segment on each transcript.

TABLE 32

Segment location on transcripts

| Transcript name | Segment starting position | Segment ending position |
|---|---|---|
| HSAPHOL_T10 | 1045 | 1114 |
| (SEQ ID NO:11) | | |
| HSAPHOL_T4 | 880 | 949 |
| (SEQ ID NO:12) | | |

TABLE 32-continued

Segment location on transcripts

| Transcript name | Segment starting position | Segment ending position |
|---|---|---|
| HSAPHOL_T5 | 925 | 994 |
| (SEQ ID NO:13) | | |
| HSAPHOL_T6 | 824 | 893 |
| (SEQ ID NO:14) | | |
| HSAPHOL_T7 | 1045 | 1114 |
| (SEQ ID NO:15) | | |
| HSAPHOL_T8 | 1045 | 1114 |
| (SEQ ID NO:16) | | |

Segment cluster HSAPHOL_node__34 (SEQ ID NO: 32) according to the present invention is supported by 48 libraries. The number of libraries was determined as previously described. This segment can be found in the following transcript(s): HSAPHOL_T4 (SEQ ID NO: 12), HSAPHOL_T5 (SEQ ID NO: 13), HSAPHOL_T6 (SEQ ID NO: 14), HSAPHOL_T7 (SEQ ID NO: 15) and HSAPHOL_T8 (SEQ ID NO: 16). Table 33 below describes the starting and ending position of this segment on each transcript.

TABLE 33

Segment location on transcripts

| Transcript name | Segment starting position | Segment ending position |
|---|---|---|
| HSAPHOL_T4 | 1085 | 1155 |
| (SEQ ID NO: 12) | | |
| HSAPHOL_T5 | 1130 | 1200 |
| (SEQ ID NO: 13) | | |
| HSAPHOL_T6 | 1029 | 1099 |
| (SEQ ID NO: 14) | | |
| HSAPHOL_T7 | 1250 | 1320 |
| (SEQ ID NO: 15) | | |
| HSAPHOL_T8 | 1115 | 1185 |
| (SEQ ID NO: 16) | | |

Segment cluster HSAPHOL_node__35 (SEQ ID NO: 33) according to the present invention is supported by 51 libraries. The number of libraries was determined as previously described. This segment can be found in the following transcript(s): HSAPHOL_T4 (SEQ ID NO: 12), HSAPHOL_T5 (SEQ ID NO: 13), HSAPHOL_T6 (SEQ ID NO: 14) and HSAPHOL_T8 (SEQ ID NO: 16). Table 34 below describes the starting and ending position of this segment on each transcript.

TABLE 34

Segment location on transcripts

| Transcript name | Segment starting position | Segment ending position |
|---|---|---|
| HSAPHOL_T4 | 1156 | 1221 |
| (SEQ ID NO: 12) | | |
| HSAPHOL_T5 | 1201 | 1266 |
| (SEQ ID NO: 13) | | |
| HSAPHOL_T6 | 1100 | 1165 |
| (SEQ ID NO: 14) | | |
| HSAPHOL_T8 | 1186 | 1251 |
| (SEQ ID NO: 16) | | |

Segment cluster HSAPHOL_node__36 (SEQ ID NO: 34) according to the present invention is supported by 47 libraries. The number of libraries was determined as previously described. This segment can be found in the following transcript(s): HSAPHOL_T4 (SEQ ID NO: 12), HSAPHOL_T5 (SEQ ID NO: 13), HSAPHOL T6 (SEQ ID NO: 14), HSAPHOL T7 (SEQ ID NO: 15) and HSAPHOL_T8 (SEQ ID NO: 16). Table 35 below describes the starting and ending position of this segment on each transcript.

TABLE 35

Segment location on transcripts

| Transcript name | Segment starting position | Segment ending position |
|---|---|---|
| HSAPHOL_T4 (SEQ ID NO: 12) | 1222 | 1276 |
| HSAPHOL_T5 (SEQ ID NO: 13) | 1267 | 1321 |
| HSAPHOL_T6 (SEQ ID NO: 14) | 1166 | 1220 |
| HSAPHOL_T7 (SEQ ID NO: 15) | 1321 | 1375 |
| HSAPHOL_T8 (SEQ ID NO: 16) | 1252 | 1306 |

Segment cluster HSAPHOL_node_41 (SEQ ID NO: 35) according to the present invention is supported by 60 libraries. The number of libraries was determined as previously described. This segment can be found in the following transcript(s): HSAPHOL_T4 (SEQ ID NO: 12), HSAPHOL_T5 (SEQ ID NO: 13), HSAPHOL_T6 (SEQ ID NO: 14), HSAPHOL_T7 (SEQ ID NO: 15) and HSAPHOL_T8 (SEQ ID NO: 16). Table 36 below describes the starting and ending position of this segment on each transcript.

TABLE 36

Segment location on transcripts

| Transcript name | Segment starting position | Segment ending position |
|---|---|---|
| HSAPHOL_T4 (SEQ ID NO: 12) | 1760 | 1869 |
| HSAPHOL_T5 (SEQ ID NO: 13) | 1805 | 1914 |
| HSAPHOL_T6 (SEQ ID NO: 14) | 1704 | 1813 |
| HSAPHOL_T7 (SEQ ID NO: 15) | 1859 | 1968 |
| HSAPHOL_T8 (SEQ ID NO: 16) | 1790 | 1899 |

Microarray (chip) data is also available for this gene as follows. As described above with regard to the cluster itself, various oligonucleotides were tested for being differentially expressed in various disease conditions, particularly cancer. The following oligonucleotides were found to hit this segment (with regard to ovarian cancer), shown in Table 37.

TABLE 37

Oligonucleotides related to this gene

| Oligonucleotide name | Overexpressed in cancers | Chip reference |
|---|---|---|
| HSAPHOL_0_11_0 (SEQ ID NO: 1012) | Ovarian cancer | Ovary |

Variant protein alignment to the previously known protein:

Sequence name: /tmp/rTOip7OHMr/xEFXPsrVLD: PPBT_HUMAN

Sequence documentation:

Alignment of: HSAPHOL_P2 (SEQ ID NO: 37) x PPBT_HUMAN . . .

Alignment segment 1/1:

Quality: 4926.00

Escore: 0

Matching length: 507 Total length: 507

Matching Percent Similarity: 99.61 Matching Percent

Identity: 99.41

Total Percent Similarity: 99.61 Total Percent

Identity: 99.41

Gaps: 0

Alignment:

```
 47 LCAEKEKDPKYWRDQAQETLKYALELQKLNTNVAKNVIMFLGDGMGVSTV  96
    | ||||||||||||||||||||||||||||||||||||||||||||||||
 18 LVPEKEKDPKYWRDQAQETLKYALELQKLNTNVAKNVIMFLGDGMGVSTV  67

97 TAARILKGQLHHNPGEETRLEMDKFPFVALSKTYNTNAQVPDSAGTATAY  146
    |||||||||||||||||||||||||||||||||||||||||||||||||
 68 TAARILKGQLHHNPGEETRLEMDKFPFVALSKTYNTNAQVPDSAGTATAY  117

147 LCGVKANEGTVGVSAATERSRCNTTQGNEVTSILRWAKDAGKSVGIVTTT  196
    |||||||||||||||||||||||||||||||||||||||||||||||||
118 LCGVKANEGTVGVSAATERSRCNTTQGNEVTSILRWAKDAGKSVGIVTTT  167

197 RVNHATPSAAYAHSADRDWYSDNEMPPEALSQGCKDIAYQLMHNIRDIDV  246
    |||||||||||||||||||||||||||||||||||||||||||||||||
168 RVNHATPSAAYAHSADRDWYSDNEMPPEALSQGCKDIAYQLMHNIRDIDV  217
```

-continued

```
247  IMGGGRKYMYPKNKTDVEYESDEKARGTRLDGLDLVDTWKSFKPRYKHSH  296
     ||||||||||||||||||||||||||||||||||||||||||||||||||
218  IMGGGRKYMYPKNKTDVEYESDEKARGTRLDGLDLVDTWKSFKPRHKHSH  267

297  FIWNRTELLTLDPHNVDYLLGLFEPGDMQYELNRNNVTDPSLSEMVVAI  346
     ||||||||||||||||||||||||||||||||||||||||||||||||
268  FIWNRTELLTLDPHNVDYLLGLFEPGDMQYELNRNNVTDPSLSEMVVAI  317

347  QILRKNPKGFFLLVEGGRIDHGHHEGKAKQALHEAVEMDRAIGQAGSLTS  396
     |||||||||||||||||||||||||||||||||||||||||||||||||
318  QILRKNPKGFFLLVEGGRIDHGHHEGKAKQALHEAVEMDRAIGQAGSLTS  367

397  SEDTLTVVTADHSHVFTFGGYTPRGNSIFGLAPMLSDTDKKPFTAILYGN  446
     |||||||||||||||||||||||||||||||||||||||||||||||||
368  SEDTLTVVTADHSHVFTFGGYTPRGNSIFGLAPMLSDTDKKPFTAILYGN  417

447  GPGYKVVGGERENVSMVDYAHNNYQAQSAVPLRHETHGGEDVAVFSKGPM  496
     |||||||||||||||||||||||||||||||||||||||||||||||||
418  GPGYKVVGGERENVSMVDYAHNNYQAQSAVPLRHETHGGEDVAVFSKGPM  467

497  AHLLHGVHEQNYVPHVMAYAACIGANLGHCAPASSAGSLAAGPLLLALAL  546
     |||||||||||||||||||||||||||||||||||||||||||||||||
468  AHLLHGVHEQNYVPHVMAYAACIGANLGHCAPASSAGSLAAGPLLLALAL  517
547  YPLSVLF                                           553
     |||||||
518  YPLSVLF                                           524
```

Sequence name: /tmp/rTOip7OHMr/xEFXPsrVLD: AAH21289

Sequence documentation:

Alignment of: HSAPHOL_P2 (SEQ ID NO: 37) x AAH21289 . . .

Alignment segment 1/1:
 Quality: 5108.00

Escore: 0
 Matching length: 531 Total length: 586

Matching Percent Similarity: 100.00 Matching Percent Identity: 100.00

Total Percent Similarity: 90.61 Total Percent Identity: 90.61
 Gaps: 1

Alignment:

```
 23  PATPRPLSWLRAPTRLCLDGPSPVLCA.....................  49
     ||||||||||||||||||||||||||
  1  PATPRPLSWLRAPTRLCLDGPSPVLCAGLEHQLTSDHCQPTPSHPRRLHL  50

50  ............................EKEKDPKYWRDQAQETLK   67
                                 |||||||||||||||||||
 51  WAPGIKQVLGCTMISPFLVLAIGTCLTNSLVPEKEKDPKYWRDQAQETLK  100

68  YALELQKLNTNVAKNVIMFLGDGMGVSTVTAARILKGQLHHNPGEETRLE  117
     |||||||||||||||||||||||||||||||||||||||||||||||||
101  YALELQKLNTNVAKNVIMFLGDGMGVSTVTAARILKGQLHHNPGEETRLE  150

118  MDKFPFVALSKTYNTNAQVPDSAGTATAYLCGVKANEGTVGVSAATERSR  167
     |||||||||||||||||||||||||||||||||||||||||||||||||
151  MDKFPFVALSKTYNTNAQVPDSAGTATAYLCGVKANEGTVGVSAATERSR  200

168  CNTTQGNEVTSILRWAKDAGKSVGIVTTTRVNHATPSAAYAHSADRDWYS  217
     |||||||||||||||||||||||||||||||||||||||||||||||||
201  CNTTQGNEVTSILRWAKDAGKSVGIVTTTRVNHATPSAAYAHSADRDWYS  250

218  DNEMPPEALSQGCKDIAYQLMHNIRDIDVIMGGGRKYMYPKNKTDVEYES  267
     |||||||||||||||||||||||||||||||||||||||||||||||||
251  DNEMPPEALSQGCKDIAYQLMHNIRDIDVIMGGGRKYMYPKNKTDVEYES  300

268  DEKARGTRLDGLDLVDTWKSFKPRYKHSHFIWNRTELLTLDPHNVDYLLG  317
     |||||||||||||||||||||||||||||||||||||||||||||||||
301  DEKARGTRLDGLDLVDTWKSFKPRYKHSHFIWNRTELLTLDPHNVDYLLG  350

318  LFEPGDMQYELNRNNVTDPSLSEMVVAIQILRKNPKGFFLLVEGGRIDH  367
     ||||||||||||||||||||||||||||||||||||||||||||||||
351  LFEPGDMQYELNRNNVTDPSLSEMVVAIQILRKNPKGFFLLVEGGRIDH  400
```

-continued

```
368  GHHEGKAKQALHEAVEMDRAIGQAGSLTSSEDTLTVVTADHSHVFTFGGY  417
     |||||||||||||||||||||||||||||||||||||||||||||||||
401  GHHEGKAKQALHEAVEMDRAIGQAGSLTSSEDTLTVVTADHSHVFTFGGY  450

418  TPRGNSIFGLAPMLSDTDKKPFTAILYGNGPGYKVVGGERENVSMVDYAH  467
     |||||||||||||||||||||||||||||||||||||||||||||||||
451  TPRGNSIFGLAPMLSDTDKKPFTAILYGNGPGYKVVGGERENVSMVDYAH  500

468  NNYQAQSAVPLRHETHGGEDVAVFSKGPMAHLLHGVHEQNYVPHVMAYAA  517
     |||||||||||||||||||||||||||||||||||||||||||||||||
501  NNYQAQSAVPLRHETHGGEDVAVFSKGPMAHLLHGVHEQNYVPHVMAYAA  550

518  CIGANLGHCAPASSAGSLAAGPLLLALALYPLSVLF  553
     |||||||||||||||||||||||||||||||||||
551  CIGANLGHCAPASSAGSLAAGPLLLALALYPLSVLF  586
```

Sequence name: /tmp/pYLJnulFqm/UcqrrsA3UA: PPBT_HUMAN

Sequence documentation:

Alignment of: HSAPHOL_P3 (SEQ ID NO: 38) x PPBT_HUMAN...

Alignment segment 1/1:
  Quality: 4615.00
Escore: 0
  Matching length: 484 Total length: 524

Matching Percent Similarity: 100.00 Matching Percent Identity: 99.79

Total Percent Similarity: 92.37 Total Percent Identity: 92.18

Gaps: 1

Alignment:

```
  1  MISPFLVLAIGTCLTNSLVP.............................  20
     ||||||||||||||||||||
  1  MISPFLVLAIGTCLTNSLVPEKEKDPKYWRDQAQETLKYALELQKLNTNV  50

21  ..........GMGVSTVTAARILKGQLHHNPGEETRLEMDKFPVALSKT  60
               ||||||||||||||||||||||||||||||||||||||||
 51  AKNVIMFLGDGMGVSTVTAARILKGQLHHNPGEETRLEMDKFPVALSKT  100

61  YNTNAQVPDSAGTATAYLCGVKANEGTVGVSAATERSRCNTTQGNEVTSI  110
     |||||||||||||||||||||||||||||||||||||||||||||||||
101  YNTNAQVPDSAGTATAYLCGVKANEGTVGVSAATERSRCNTTQGNEVTSI  150

111  LRWAKDAGKSVGIVTTTRVNHATPSAAYAHSADRDWYSDNEMPPEALSQG  160
     |||||||||||||||||||||||||||||||||||||||||||||||||
151  LRWAKDAGKSVGIVTTTRVNHATPSAAYAHSADRDWYSDNEMPPEALSQG  200

161  CKDIAYQLMHNIRDIDVIMGGGRKYMYPKNKTDVEYESDEKARGTRLDGL  210
     |||||||||||||||||||||||||||||||||||||||||||||||||
201  CKDIAYQLMHNIRDIDVIMGGGRKYMYPKNKTDVEYESDEKARGTRLDGL  250

211  DLVDTWKSFKPRYKHSHFIWNRTELLTLDPHNVDYLLGLFEPGDMQYELN  260
     |||||||||||||||||||||||||||||||||||||||||||||||||
251  DLVDTWKSFKPRYKHSHFIWNRTELLTLDPHNVDYLLGLFEPGDMQYELN  300

261  RNNVTDPSLSEMVVVAIQILRKNPKGFFLLVEGGRIDHGHHEGKAKQALH  310
     |||||||||||||||||||||||||||||||||||||||||||||||||
301  RNNVTDPSLSEMVVVAIQILRKNPKGFFLLVEGGRIDHGHHEGKAKQALH  350

311  EAVEMDRAIGQAGSLTSSEDTLTVVTADHSHVFTFGGYTPRGNSIFGLAP  360
     |||||||||||||||||||||||||||||||||||||||||||||||||
351  EAVEMDRAIGQAGSLTSSEDTLTVVTADHSHVFTFGGYTPRGNSIFGLAP  400

361  MLSDTDKKPFTAILYGNGPGYKVVGGERENVSMVDYAHNNYQAQSAVPLR  410
     |||||||||||||||||||||||||||||||||||||||||||||||||
401  MLSDTDKKPFTAILYGNGPGYKVVGGERENVSMVDYAHNNYQAQSAVPLR  450

411  HETHGGEDVAVFSKGPMAHLLHGVHEQNYVPHVMAYAACIGANLGHCAPA  460
     |||||||||||||||||||||||||||||||||||||||||||||||||
451  HETHGGEDVAVFSKGPMAHLLHGVHEQNYVPHVMAYAACIGANLGHCAPA  500

461  SSAGSLAAGPLLLALALYPLSVLF  484
     ||||||||||||||||||||||||
501  SSAGSLAAGPLLLALALYPLSVLF  524
```

225

Sequence name: /tmp/pYLJnulFqm/UcqrrsA3UA: AAH21289

Sequence documentation:

Alignment of: HSAPHOL_P3 (SEQ ID NO: 38) x AAH21289 . . .

Alignment segment 1/1:
Quality: 4626.00

Escore: 0
Matching length: 484 Total length: 524

Matching Percent Similarity: 100.00 Matching Percent

Identity: 100.00
Total Percent Similarity: 92.37 Total Percent

Identity: 92.37
Gaps: 1

Alignment:

226

Sequence name: /tmp/iYbOicGuUc/lMWHKKvS1d: PPBT_HUMAN

Sequence documentation:

Alignment of: HSAPHOL_P4 (SEQ ID NO: 39) x PPBT_HUMAN . . .

Alignment segment 1/1:
Quality: 4517.00

Escore: 0
Matching length: 463 Total length: 463

Matching Percent Similarity: 100.00 Matching Percent

Identity: 99.78
Total Percent Similarity: 100.00 Total Percent

Identity: 99.78
Gaps: 0

```
  1  MISPFLVLAIGTCLTNSLVP............................    20
     ||||||||||||||||||||
 63  MISPFLVLAIGTCLTNSLVPEKEKDPKYWRDQAQETLKYALELQKLNTNV   112

21  ..........GMGVSTVTAARILKGQLHHNPGEETRLEMDKFPFVALSKT    60
               |||||||||||||||||||||||||||||||||||||||
113  AKNVIMFLGDGMGVSTVTAARILKGQLHHNPGEETRLEMDKFPFVALSKT   162

61  YNTNAQVPDSAGTATAYLCGVKANEGTVGVSAATERSRCNTTQGNEVTSI   110
     |||||||||||||||||||||||||||||||||||||||||||||||||
163  YNTNAQVPDSAGTATAYLCGVKANEGTVGVSAATERSRCNTTQGNEVTSI   212

111  LRWAKDAGKSVGIVTTTRVNHATPSAAYAHSADRDWYSDNEMPPEALSQG   160
     |||||||||||||||||||||||||||||||||||||||||||||||||
213  LRWAKDAGKSVGIVTTTRVNHATPSAAYAHSADRDWYSDNEMPPEALSQG   262

161  CKDIAYQLMHNIRDIDVIMGGGRKYMYPKNKTDVEYESDEKARGTRLDGL   210
     |||||||||||||||||||||||||||||||||||||||||||||||||
263  CKDIAYQLMHNIRDIDVIMGGGRKYMYPKNKTDVEYESDEKARGTRLDGL   312

211  DLVDTWKSFKPRYKHSHFIWNRTELLTLDPHNVDYLLGLFEPGDMQYELN   260
     |||||||||||||||||||||||||||||||||||||||||||||||||
313  DLVDTWKSFKPRYKHSHFIWNRTELLTLDPHNVDYLLGLFEPGDMQYELN   362

261  RNNVTDPSLSEMVVVAIQILRKNPKGFFLLVEGGRIDHGHHEGKAKQALH   310
     |||||||||||||||||||||||||||||||||||||||||||||||||
363  RNNVTDPSLSEMVVVAIQILRKNPKGFFLLVEGGRIDHGHHEGKAKQALH   412

311  EAVEMDRAIGQAGSLTSSEDTLTVVTADHSHVFTFGGYTPRGNSIFGLAP   360
     |||||||||||||||||||||||||||||||||||||||||||||||||
413  EAVEMDRAIGQAGSLTSSEDTLTVVTADHSHVFTFGGYTPRGNSIFGLAP   462

361  MLSDTDKKPFTAILYGNGPGYKVVGGERENVSMVDYAHNNYQAQSAVPLR   410
     |||||||||||||||||||||||||||||||||||||||||||||||||
463  MLSDTDKKPFTAILYGNGPGYKVVGGERENVSMVDYAHNNYQAQSAVPLR   512

411  HETHGGEDVAVFSKGPMAHLLHGVHEQNYVPHVMAYAACIGANLGHCAPA   460
     |||||||||||||||||||||||||||||||||||||||||||||||||
513  HETHGGEDVAVFSKGPMAHLLHGVHEQNYVPHVMAYAACIGANLGHCAPA   562

461  SSAGSLAAGPLLLALALYPLSVLF   484
     ||||||||||||||||||||||||
563  SSAGSLAAGPLLLALALYPLSVLF   586
```

Alignment:

```
  1 MGVSTVTAARILKGQLHHNPGEETRLEMDKFPFVALSKTYNTNAQVPDSA   50
    ||||||||||||||||||||||||||||||||||||||||||||||||||
 62 MGVSTVTAARILKGQLHHNPGEETRLEMDKFPFVALSKTYNTNAQVPDSA  111

51 GTATAYLCGVKANEGTVGVSAATERSRCNTTQGNEVTSILRWAKDAGKSV  100
    ||||||||||||||||||||||||||||||||||||||||||||||||||
112 GTATAYLCGVKANEGTVGVSAATERSRCNTTQGNEVTSILRWAKDAGKSV  161

101 GIVTTTRVNHATPSAAYAHSADRDWYSDNEMPPEALSQGCKDIAYQLMHN  150
    ||||||||||||||||||||||||||||||||||||||||||||||||||
162 GIVTTTRVNHATPSAAYAHSADRDWYSDNEMPPEALSQGCKDIAYQLMHN  211

151 IRDIDVIMGGGRKYMYPKNKTDVEYESDEKARGTRLDGLDLVDTWKSFKP  200
    ||||||||||||||||||||||||||||||||||||||||||||||||||
212 IRDIDVIMGGGRKYMYPKNKTDVEYESDEKARGTRLDGLDLVDTWKSFKP  261

201 RYKHSHFIWNRTELLTLDPHNVDYLLGLFEPGDMQYELNRNNVTDPSLSE  250
    |:||||||||||||||||||||||||||||||||||||||||||||||||
262 RYKHSHFIWNRTELLTLDPHNVDYLLGLFEPGDMQYELNRNNVTDPSLSE  311

251 MVVVAIQILRKNPKGFFLLVEGGRIDHGHHEGKAKQALHEAVEMDRAIGQ  300
    ||||||||||||||||||||||||||||||||||||||||||||||||||
312 MVVVAIQILRKNPKGFFLLVEGGRIDHGHHEGKAKQALHEAVEMDRAIGQ  361

301 AGSLTSSEDTLTVVTADHSHVFTFGGYTPRGNSIFGLAPMLSDTDKKPFT  350
    ||||||||||||||||||||||||||||||||||||||||||||||||||
362 AGSLTSSEDTLTVVTADHSHVFTFGGYTPRGNSIFGLAPMLSDTDKKPFT  411

351 AILYGNGPGYKVVGGERENVSMVDYAHNNYQAQSAVPLRHETHGGEDVAV  400
    ||||||||||||||||||||||||||||||||||||||||||||||||||
412 AILYGNGPGYKVVGGERENVSMVDYAHNNYQAQSAVPLRHETHGGEDVAV  461

401 FSKGPMAHLLHGVHEQNYVPHVMAYAACIGANLGHCAPASSAGSLAAGPL  450
    ||||||||||||||||||||||||||||||||||||||||||||||||||
462 FSKGPMAHLLHGVHEQNYVPHVMAYAACIGANLGHCAPASSAGSLAAGPL  511

451 LLALALYPLSVLF                                       463
    |||||||||||||
512 LLALALYPLSVLF                                       524
```

Sequence name: /tmp/iYbOicGuUc/lMWHKKvS1d: AAH21289

Sequence documentation:

Alignment of: HSAPHOL_P4 (SEQ ID NO: 39) x AAH21289 . . .

Alignment segment 1/1:
  Quality: 4528.00

Escore: 0
  Matching length: 463 Total length: 463

Matching Percent Similarity: 100.00 Matching Percent
Identity: 100.00
  Total Percent Similarity: 100.00 Total Percent
Identity: 100.00
  Gaps: 0

Alignment:

```
  1 MGVSTVTAARILKGQLHHNPGEETRLEMDKFPFVALSKTYNTNAQVPDSA   50
    ||||||||||||||||||||||||||||||||||||||||||||||||||
124 MGVSTVTAARILKGQLHHNPGEETRLEMDKFPFVALSKTYNTNAQVPDSA  173

51 GTATAYLCGVKANEGTVGVSAATERSRCNTTQGNEVTSILRWAKDAGKSV  100
    ||||||||||||||||||||||||||||||||||||||||||||||||||
174 GTATAYLCGVKANEGTVGVSAATERSRCNTTQGNEVTSILRWAKDAGKSV  223

101 GIVTTTRVNHATPSAAYAHSADRDWYSDNEMPPEALSQGCKDIAYQLMHN  150
    ||||||||||||||||||||||||||||||||||||||||||||||||||
224 GIVTTTRVNHATPSAAYAHSADRDWYSDNEMPPEALSQGCKDIAYQLMHN  273

151 IRDIDVIMGGGRKYMYPKNKTDVEYESDEKARGTRLDGLDLVDTWKSFKP  200
    ||||||||||||||||||||||||||||||||||||||||||||||||||
274 IRDIDVIMGGGRKYMYPKNKTDVEYESDEKARGTRLDGLDLVDTWKSFKP  323
```

-continued

```
201 RYKHSHFIWNRTELLTLDPHNVDYLLGLFEPGDMQYELNRNNVTDPSLSE 250
    ||||||||||||||||||||||||||||||||||||||||||||||||||
324 RYKHSHFIWNRTELLTLDPHNVDYLLGLFEPGDMQYELNRNNVTDPSLSE 373

251 MVVVAIQILRKNPKGFFLLVEGGRIDHGHHEGKAKQALHEAVEMDRAIGQ 300
    ||||||||||||||||||||||||||||||||||||||||||||||||||
374 MVVVAIQILRKNPKGFFLLVEGGRIDHGHHEGKAKQALHEAVEMDRAIGQ 423

301 AGSLTSSEDTLTVVTADHSHVFTFGGYTPRGNSIFGLAPMLSDTDKKPFT 350
    ||||||||||||||||||||||||||||||||||||||||||||||||||
424 AGSLTSSEDTLTVVTADHSHVFTFGGYTPRGNSIFGLAPMLSDTDKKPFT 473

351 AILYGNGPGYKVVGGERENVSMVDYAHNNYQAQSAVPLRHETHGGEDVAV 400
    ||||||||||||||||||||||||||||||||||||||||||||||||||
474 AILYGNGPGYKVVGGERENVSMVDYAHNNYQAQSAVPLRHETHGGEDVAV 523

401 FSKGPMAHLLHGVHEQNYVPHVMAYAACIGANLGHCAPASSAGSLAAGPL 450
    ||||||||||||||||||||||||||||||||||||||||||||||||||
524 FSKGPMAHLLHGVHEQNYVPHVMAYAACIGANLGHCAPASSAGSLAAGPL 573

451 LLALALYPLSVLF 463
    |||||||||||||
574 LLALALYPLSVLF 586
```

Sequence name: /tmp/v0YiupJ4xl/W6HH5Tm6Ym: PPBT_HUMAN

Sequence documentation:

Alignment of: HSAPHOL_P5 (SEQ ID NO: 40) x PPBT_HUMAN . . .

Alignment segment 1/1:
  Quality: 4816.00
  Escore: 0
  Matching length: 502 Total length: 524

Matching Percent Similarity: 100.00 Matching Percent Identity: 99.80
  Total Percent Similarity: 95.80 Total Percent Identity: 95.61
  Gaps: 1

Alignment:

```
  1 MISPFLVLAIGTCLTNSLVPEKEKDPKYWRDQAQETLKYALELQKLNTNV  50
    ||||||||||||||||||||||||||||||||||||||||||||||||||
  1 MISPFLVLAIGTCLTNSLVPEKEKDPKYWRDQAQETLKYALELQKLNTNV  50

51 AKNVIMFLGDGMGVSTVTAARILKGQLHHNPGEETRLEMDKFPFVALSKT 100
    ||||||||||||||||||||||||||||||||||||||||||||||||||
 51 AKNVIMFLGDGMGVSTVTAARILKGQLHHNPGEETRLEMDKFPFVALSKT 100

101 YNTNAQVPDSAGTATAYLCGVKANEGTVGVSAATERSRCNTTQGNEVTSI 150
    ||||||||||||||||||||||||||||||||||||||||||||||||||
101 YNTNAQVPDSAGTATAYLCGVKANEGTVGVSAATERSRCNTTQGNEVTSI 150

151 LRWAKDAGKSVGIVTTTRVNHATPSAAYAHSADRDWYSDNEMPPEALSQC 200
    ||||||||||||||||||||||||||||||||||||||||||||||||||
151 LRWAKDAGKSVGIVTTTRVNHATPSAAYAHSADRDWYSDNEMPPEALSQC 200

201 CKDIAYQLMHNIRDIDVIMGGGRKYMYPKNKTDVEYESDEKARGTRLDGL 250
    ||||||||||||||||||||||||||||||||||||||||||||||||||
201 CKDIAYQLMHNIRDIDVIMGGGRKYMYPKNKTDVEYESDEKARGTRLDGL 250

251 DLVDTWKSFKPRYKHSHFIWNRTELLTLDPHNVDYLLGLFEPGDMQYELN 300
    ||||||||||||:|||||||||||||||||||||||||||||||||||||
251 DLVDTWKSFKPRYKHSHFIWNRTELLTLDPHNVDYLLGLFEPGDMQYELN 300

301 RNNVTDPSLSEMVVVAIQILRKNPKGFFLLVEGGRIDHGHHEGKAKQALH 350
    ||||||||||||||||||||||||||||||||||||||||||||||||||
301 RNNVTDPSLSEMVVVAIQILRKNPKGFFLLVEGGRIDHGHHEGKAKQALH 350

351 EAVEM...................DHSHVFTFGGYTPRGNSIFGLAP   378
    |||||                   ||||||||||||||||||||||||
351 EAVEMDRAIGQAGSLTSSEDTLTVVTADHSHVFTFGGYTPRGNSIFGLAP 400

379 MLSDTDKKPFTAILYGNGPGYKVVGGERENVSMVDYAHNNYQAQSAVPLR 428
    ||||||||||||||||||||||||||||||||||||||||||||||||||
401 MLSDTDKKPFTAILYGNGPGYKVVGGERENVSMVDYAHNNYQAQSAVPLR 450
```

-continued

```
429  HETHGGEDVAVFSKGPMAHLLHGVHEQNYVPHVMAYAACIGANLGHCAPA  478
     ||||||||||||||||||||||||||||||||||||||||||||||||||
451  HETHGGEDVAVFSKGPMAHLLHGVHEQNYVPHVMAYAACIGANLGHCAPA  500

479  SSAGSLAAGPLLLALALYPLSVLF                            502
     ||||||||||||||||||||||||
501  SSAGSLAAGPLLLALALYPLSVLF                            524
```

Sequence name: /tmp/v0YiupJ4xl/W6HH5Tm6Ym: AAH21289

Identity: 95.80
Gaps: 1

Sequence documentation:

Alignment:

```
  1  MISPFLVLAIGTCLTNSLVPEKEKDPKYWRDQAQETLKYALELQKLNTNV   50
     ||||||||||||||||||||||||||||||||||||||||||||||||||
 63  MISPFLVLAIGTCLTNSLVPEKEKDPKYWRDQAQETLKYALELQKLNTNV  112

51  AKNVIMFLGDGMGVSTVTAARILKGQLHHNPGEETRLEMDKFPFVALSKT  100
     ||||||||||||||||||||||||||||||||||||||||||||||||||
113  AKNVIMFLGDGMGVSTVTAARILKGQLHHNPGEETRLEMDKFPFVALSKT  162

101  YNTNAQVPDSAGTATAYLCGVKANEGTVGVSAATERSRCNTTQGNEVTSI  150
     ||||||||||||||||||||||||||||||||||||||||||||||||||
163  YNTNAQVPDSAGTATAYLCGVKANEGTVGVSAATERSRCNTTQGNEVTSI  212

151  LRWAKDAGKSVGIVTTTRVNHATPSAAYAHSADRDWYSDNEMPPEALSQG  200
     ||||||||||||||||||||||||||||||||||||||||||||||||||
213  LRWAKDAGKSVGIVTTTRVNHATPSAAYAHSADRDWYSDNEMPPEALSQG  262

201  CKDIAYQLMHNIRDIDVIMGGGRKYMYPKNKTDVEYESDEKARGTRLDGL  250
     ||||||||||||||||||||||||||||||||||||||||||||||||||
263  CKDIAYQLMHNIRDIDVIMGGGRKYMYPKNKTDVEYESDEKARGTRLDGL  312

251  DLVDTWKSFKPRYKHSHFIWNRTELLTLDPHNVDYLLGLFEPGDMQYELN  300
     ||||||||||||||||||||||||||||||||||||||||||||||||||
313  DLVDTWKSFKPRYKHSHFIWNRTELLTLDPHNVDYLLGLFEPGDMQYELN  362

301  RNNVTDPSLSEMVVVAIQILRKNPKGFFLLVEGGRIDHGHHEGKAKQALH  350
     ||||||||||||||||||||||||||||||||||||||||||||||||||
363  RNNVTDPSLSEMVVVAIQILRKNPKGFFLLVEGGRIDHGHHEGKAKQALH  412

351  EAVEM....................DHSHVFTFGGYTPRGNSIFGLAP   378
     |||||                    ||||||||||||||||||||||||
413  EAVEMDRAIGQAGSLTSSEDTLTVVTADHSHVFTFGGYTPRGNSIFGLAP  462

379  MLSDTDKKPFTAILYGNGPGYKVVGGERENVSMVDYAHNNYQAQSAVPLR  428
     ||||||||||||||||||||||||||||||||||||||||||||||||||
463  MLSDTDKKPFTAILYGNGPGYKVVGGERENVSMVDYAHNNYQAQSAVPLR  512

429  HETHGGEDVAVFSKGPMAHLLHGVHEQNYVPHVMAYAACIGANLGHCAPA  478
     ||||||||||||||||||||||||||||||||||||||||||||||||||
513  HETHGGEDVAVFSKGPMAHLLHGVHEQNYVPHVMAYAACIGANLGHCAPA  562

479  SSAGSLAAGPLLLALALYPLSVLF                            502
     ||||||||||||||||||||||||
563  SSAGSLAAGPLLLALALYPLSVLF                            586
```

Alignment of: HSAPHOL_P5 (SEQ ID NO: 40) x AAH21289 . . .

Alignment segment 1/1:
  Quality: 4827.00

Escore: 0
  Matching length: 502 Total length: 524

Matching Percent Similarity: 100.00 Matching Percent Identity: 100.00
  Total Percent Similarity: 95.80 Total Percent Sequence name: /tmp/L1ylq0ddii/lFFtdNNCUx:PPBT_HUMAN Sequence documentation:

Alignment of: HSAPHOL_P6 (SEQ ID NO: 41) x PPBT_HUMAN . . .

Alignment segment 1/1:
  Quality: 4575.00

Escore: 0
  Matching length: 479 Total length: 524

Matching Percent Similarity: 100.00 Matching Percent Identity: 99.79
  Total Percent Similarity: 91.41 Total Percent Identity: 91.22
  Gaps: 1

Alignment:

```
  1  MISPFLVLAIGTCLTNSLVPEKEKDPKYWRDQAQETLKYALELQKLNTNV   50
     ||||||||||||||||||||||||||||||||||||||||||||||||||
  1  MISPFLVLAIGTCLTNSLVPEKEKDPKYWRDQAQETLKYALELQKLNTNV   50

51  AKNVIMFLGDGMGVSTVTAARILKGQLHHNPGEETRLEMDKFPFVALSKT  100
     ||||||||||||||||||||||||||||||||||||||||||||||||||
 51  AKNVIMFLGDGMGVSTVTAARILKGQLHHNPGEETRLEMDKFPFVALSKT  100

101  YNTNAQVPDSAGTATAYLCGVKANEGTVGVSAATERSRCNTTQGNEVTSI  150
     ||||||||||||||||||||||||||||||||||||||||||||||||||
101  YNTNAQVPDSAGTATAYLCGVKANEGTVGVSAATERSRCNTTQGNEVTSI  150

151  LRWAKDAGKSVGIVTTTRVNHATPSAAYAHSADRDWYSDNEMPPEALSQG  200
     ||||||||||||||||||||||||||||||||||||||||||||||||||
151  LRWAKDAGKSVGIVTTTRVNHATPSAAYAHSADRDWYSDNEMPPEALSQG  200

201  CKDIAYQLMHNIRDIDVIMGGGRKYMYPKNKTDVEYESDEKARGTRLDGL  250
     ||||||||||||||||||||||||||||||||||||||||||||||||||
201  CKDIAYQLMHNIRDIDVIMGGGRKYMYPKNKTDVEYESDEKARGTRLDGL  250

251  DLVDTWKSFKPRYKHSHFIWNRTELLTLDPHNVDYLL.............  287
     ||||||||||||:|||||||||||||||||||||||
251  DLVDTWKSFKPRYKHSHFIWNRTELLTLDPHNVDYLLGLFEPGDMQYELN  300

288  ..............................GGRIDHGHHEGKAKQALH  305
                                   ||||||||||||||||||
301  RNNVTDPSLSEMVVVAIQILRKNPKGFFLLVEGGRIDHGHHEGKAKQALH  350

306  EAVEMDRAIGQAGSLTSSEDTLTVVTADHSHVFTFGGYTPRGNSIFGLAP  355
     ||||||||||||||||||||||||||||||||||||||||||||||||||
351  EAVEMDRAIGQAGSLTSSEDTLTVVTADHSHVFTFGGYTPRGNSIFGLAP  400

356  MLSDTDKKPFTAILYGNGPGYKVVGGERENVSMVDYAHNNYAQSAVPLR   405
     ||||||||||||||||||||||||||||||||||||||||||||||||
401  MLSDTDKKPFTAILYGNGPGYKVVGGERENVSMVDYAHNNYAQSAVPLR   450

406  HETHGGEDVAVFSKGPMAHLLHGVHEQNYVPHVMAYAACIGANLGHCAPA  455
     ||||||||||||||||||||||||||||||||||||||||||||||||||
451  HETHGGEDVAVFSKGPMAHLLHGVHEQNYVPHVMAYAACIGANLGHCAPA  500

456  SSAGSLAAGPLLLALALYPLSVLF                            479
     ||||||||||||||||||||||||
501  SSAGSLAAGPLLLALALYPLSVLF                            524
```

Quality: 4586.00
Escore: 0
  Matching length: 479 Total length: 524
Matching Percent Similarity: 100.00 Matching Percent Identity: 100.00

Sequence name: /tmp/L1ylq0ddii/lFFtdNNCUx:AAH21289

Sequence documentation:

Alignment of: HSAPHOL_P6 (SEQ ID NO: 41) x AAH21289 . . .

Alignment segment 1/1:

Total Percent Similarity: 91.41 Total Percent Identity: 91.41

Gaps: 1

Alignment:

```
  1  MISPFLVLAIGTCLTNSLVPEKEKDPKYWRDQAQETLKYALELQKLNTNV   50
     ||||||||||||||||||||||||||||||||||||||||||||||||||
 63  MISPFLVLAIGTCLTNSLVPEKEKDPKYWRDQAQETLKYALELQKLNTNV  112

51  AKNVIMFLGDGMGVSTVTAARILKGQLHHNPGEETRLEMDKFPFVALSKT  100
     ||||||||||||||||||||||||||||||||||||||||||||||||||
113  AKNVIMFLGDGMGVSTVTAARILKGQLHHNPGEETRLEMDKFPFVALSKT  162

101  YNTNAQVPDSAGTATAYLCGVKANEGTVGVSAATERSRCNTTQGNEVTSI  150
     ||||||||||||||||||||||||||||||||||||||||||||||||||
163  YNTNAQVPDSAGTATAYLCGVKANEGTVGVSAATERSRCNTTQGNEVTSI  212
```

-continued

```
151  LRWAKDAGKSVGIVTTTRVNHATPSAAYAHSADRDWYSDNEMPPEALSQG  200
     ||||||||||||||||||||||||||||||||||||||||||||||||||
213  LRWAKDAGKSVGIVTTTRVNHATPSAAYAHSADRDWYSDNEMPPEALSQG  262

201  CKDIAYQLMHNIRDIDVIMGGGRKYMYPKNKTDVEYESDEKARGTRLDGL  250
     ||||||||||||||||||||||||||||||||||||||||||||||||||
263  CKDIAYQLMHNIRDIDVIMGGGRKYMYPKNKTDVEYESDEKARGTRLDGL  312

251  DLVDTWKSFKPRYKHSHFIWNRTELLTLDPHNVDYLL.............  287
     ||||||||||||||||||||||||||||||||||||
313  DLVDTWKSFKPRYKHSHFIWNRTELLTLDPHNVDYLLGLFEPGDMQYELN  362

288  ..............................GGRIDHGHHEGKAKQALH  305
                                   ||||||||||||||||||||
363  RNNVTDPSLSEMVVVAIQILRKNPKGFFLLVEGGRIDHGHHEGKAKQALH  412

306  EAVEMDRAIGQAGSLTSSEDTLTVVTADHSHVFTFGGYTPRGNSIFGLAP  355
     ||||||||||||||||||||||||||||||||||||||||||||||||||
413  EAVEMDRAIGQAGSLTSSEDTLTVVTADHSHVFTFGGYTPRGNSIFGLAP  462

356  MLSDTDKKPFTAILYGNGPGYKVVGGERENVSMVDYAHNNYQAQSAVPLR  405
     ||||||||||||||||||||||||||||||||||||||||||||||||||
463  MLSDTDKKPFTAILYGNGPGYKVVGGERENVSMVDYAHNNYQAQSAVPLR  512

406  HETHGGEDVAVFSKGPMAHLLHGVHEQNYVPHVMAYAACIGANLGHCAPA  455
     ||||||||||||||||||||||||||||||||||||||||||||||||||
513  HETHGGEDVAVFSKGPMAHLLHGVHEQNYVPHVMAYAACIGANLGHCAPA  562

456  SSAGSLAAGPLLLALALYPLSVLF                           479
     ||||||||||||||||||||||||
563  SSAGSLAAGPLLLALALYPLSVLF                           586
```

Sequence name: /tmp/K05Xam2Hdo/CV0GTdjKcW: PPBT_HUMAN

Sequence documentation:

Alignment of: HSAPHOL_P7 (SEQ ID NO: 42) x PPBT_HUMAN . . .

Alignment segment 1/1:

Quality: 2574.00

Escore: 0

Matching length: 264 Total length: 264

Matching Percent Similarity: 100.00 Matching Percent Identity: 99.62

Total Percent Similarity: 100.00 Total Percent Identity: 99.62

Gaps: 0

Alignment:

```
  1  MISPFLVLAIGTCLTNSLVPEKEKDPKYWRDQAQETLKYALELQKLNTNV   50
     ||||||||||||||||||||||||||||||||||||||||||||||||||
  1  MISPFLVLAIGTCLTNSLVPEKEKDPKYWRDQAQETLKYALELQKLNTNV   50

51  AKNVIMFLGDGMGVSTVTAARILKGQLHHNPGEETRLEMDKFPFVALSKT  100
     ||||||||||||||||||||||||||||||||||||||||||||||||||
 51  AKNVIMFLGDGMGVSTVTAARILKGQLHHNPGEETRLEMDKFPFVALSKT  100

101  YNTNAQVPDSAGTATAYLCGVKANEGTVGVSAATERSRCNTTQGNEVTSI  150
     ||||||||||||||||||||||||||||||||||||||||||||||||||
101  YNTNAQVPDSAGTATAYLCGVKANEGTVGVSAATERSRCNTTQGNEVTSI  150

151  LRWAKDAGKSVGIVTTTRVNHATPSAAYAHSADRDWYSDNEMPPEALSQG  200
     ||||||||||||||||||||||||||||||||||||||||||||||||||
151  LRWAKDAGKSVGIVTTTRVNHATPSAAYAHSADRDWYSDNEMPPEALSQG  200

201  CKDIAYQLMHNIRDIDVIMGGGRKYMYPKNKTDVEYESDEKARGTRLDGL  250
     ||||||||||||||||||||||||||||||||||||||||||||||||||
201  CKDIAYQLMHNIRDIDVIMGGGRKYMYPKNKTDVEYESDEKARGTRLDGL  250

251  DLVDTWKSFKPRYK                                     264
     |||||||||||||:|
251  DLVDTWKSFKPRYK                                     264
```

Sequence name: /tmp/K05Xam2Hdo/CV0GTdjKcW: AAH21289

Sequence documentation:

Alignment of: HSAPHOL_P7 (SEQ ID NO: 42) x AAH21289 . . .

Alignment segment 1/1:

Quality: 2585.00

Escore: 0

Matching length: 264 Total length: 264

Matching Percent Similarity: 100.00 Matching Percent Identity: 100.00

Total Percent Similarity: 100.00 Total Percent Identity: 100.00

Gaps: 0

Alignment:

```
  1 MISPFLVLAIGTCLTNSLVPEKEKDPKYWRDQAQETLKYALELQKLNTNV  50
    ||||||||||||||||||||||||||||||||||||||||||||||||||
 63 MISPFLVLAIGTCLTNSLVPEKEKDPKYWRDQAQETLKYALELQKLNTNV 112

51 AKNVIMFLGDGMGVSTVTAARILKGQLHHNPGEETRLEMDKFPFVALSKT 100
    ||||||||||||||||||||||||||||||||||||||||||||||||||
113 AKNVIMFLGDGMGVSTVTAARILKGQLHHNPGEETRLEMDKFPFVALSKT 162

101 YNTNAQVPDSAGTATAYLCGVKANEGTVGVSAATERSRCNTTQGNEVTSI 150
    ||||||||||||||||||||||||||||||||||||||||||||||||||
163 YNTNAQVPDSAGTATAYLCGVKANEGTVGVSAATERSRCNTTQGNEVTSI 212

151 LRWAKDAGKSVGIVTTTRVNHATPSAAYAHSADRDWYSDNEMPPEALSQG 200
    ||||||||||||||||||||||||||||||||||||||||||||||||||
213 LRWAKDAGKSVGIVTTTRVNHATPSAAYAHSADRDWYSDNEMPPEALSQG 262

201 CKDIAYQLMHNIRDIDVIMGGGRKYMYPKNKTDVEYESDEKARGTRLDGL 250
    ||||||||||||||||||||||||||||||||||||||||||||||||||
263 CKDIAYQLMHNIRDIDVIMGGGRKYMYPKNKTDVEYESDEKARGTRLDGL 312

251 DLVDTWKSFKPRYK 264
    ||||||||||||||
313 DLVDTWKSFKPRYK 326
```

Sequence name: /tmp/K05Xam2Hdo/CV0GTdjKcW: O75090 (SEQ ID NO: 958)

Sequence documentation:

Alignment of: HSAPHOL_P7 (SEQ ID NO: 42) x O75090 (SEQ ID NO: 958) . . .

Alignment segment 1/1:

Quality: 2585.00

Escore: 0

Matching length: 264 Total length: 264

Matching Percent Similarity: 100.00 Matching Percent Identity: 100.00

Total Percent Similarity: 100.00 Total Percent Identity: 100.00

Gaps: 0

Alignment:

```
  1 MISPFLVLAIGTCLTNSLVPEKEKDPKYWRDQAQETLKYALELQKLNTNV  50
    ||||||||||||||||||||||||||||||||||||||||||||||||||
  1 MISPFLVLAIGTCLTNSLVPEKEKDPKYWRDQAQETLKYALELQKLNTNV  50

51 AKNVIMFLGDGMGVSTVTAARILKGQLHHNPGEETRLEMDKFPFVALSKT 100
    ||||||||||||||||||||||||||||||||||||||||||||||||||
 51 AKNVIMFLGDGMGVSTVTAARILKGQLHHNPGEETRLEMDKFPFVALSKT 100

101 YNTNAQVPDSAGTATAYLCGVKANEGTVGVSAATERSRCNTTQGNEVTSI 150
    ||||||||||||||||||||||||||||||||||||||||||||||||||
101 YNTNAQVPDSAGTATAYLCGVKANEGTVGVSAATERSRCNTTQGNEVTSI 150

151 LRWAKDAGKSVGIVTTTRVNHATPSAAYAHSADRDWYSDNEMPPEALSQG 200
    ||||||||||||||||||||||||||||||||||||||||||||||||||
151 LRWAKDAGKSVGIVTTTRVNHATPSAAYAHSADRDWYSDNEMPPEALSQG 200

201 CKDIAYQLMHNIRDIDVIMGGGRKYMYPKNKTDVEYESDEKARGTRLDGL 250
    ||||||||||||||||||||||||||||||||||||||||||||||||||
201 CKDIAYQLMHNIRDIDVIMGGGRKYMYPKNKTDVEYESDEKARGTRLDGL 250
```

-continued

```
251  DLVDTWKSFKPRYK                                       264
     ||||||||||||||
251  DLVDTWKSFKPRYK                                       264
```

Sequence name: /tmp/H6G7vkGMmy/rS1jwUOCll: PPBT_HUMAN

Sequence documentation:

Alignment of: HSAPHOL_P8 (SEQ ID NO: 43) x PPBT_HUMAN . . .

Alignment segment 1/1:
  Quality: 2819.00

Escore: 0
  Matching length: 288 Total length: 288

Matching Percent Similarity: 100.00 Matching Percent Identity: 99.65
  Total Percent Similarity: 100.00 Total Percent Identity: 99.65
  Gaps: 0

Alignment:

Sequence documentation:

Alignment of: HSAPHOL_P8 (SEQ ID NO: 43) x AAH21289 . . .

Alignment segment 1/1:
  Quality: 2830.00

Escore: 0
  Matching length: 288 Total length: 288

Matching Percent Similarity: 100.00 Matching Percent Identity: 100.00
  Total Percent Similarity: 100.00 Total Percent Identity: 100.00
  Gaps: 0

```
  1  MISPFLVLAIGTCLTNSLVPEKEKDPKYWRDQAQETLKYALELQKLNTNV    50
     ||||||||||||||||||||||||||||||||||||||||||||||||||
  1  MISPFLVLAIGTCLTNSLVPEKEKDPKYWRDQAQETLKYALELQKLNTNV    50

51  AKNVIMFLGDGMGVSTVTAARILKGQLHHNPGEETRLEMDKFPFVALSKT   100
     ||||||||||||||||||||||||||||||||||||||||||||||||||
 51  AKNVIMFLGDGMGVSTVTAARILKGQLHHNPGEETRLEMDKFPFVALSKT   100

101  YNTNAQVPDSAGTATAYLCGVKANEGTVGVSAATERSRCNTTQGNEVTSI   150
     ||||||||||||||||||||||||||||||||||||||||||||||||||
101  YNTNAQVPDSAGTATAYLCGVKANEGTVGVSAATERSRCNTTQGNEVTSI   150

151  LRWAKDAGKSVGIVTTTRVNHATPSAAYAHSADRDWYSDNEMPPEALSQG   200
     ||||||||||||||||||||||||||||||||||||||||||||||||||
151  LRWAKDAGKSVGIVTTTRVNHATPSAAYAHSADRDWYSDNEMPPEALSQG   200

201  CKDIAYQLMHNIRDIDVIMGGGRKYMYPKNKTDVEYESDEKARGTRLDGL   250
     ||||||||||||||||||||||||||||||||||||||||||||||||||
201  CKDIAYQLMHNIRDIDVIMGGGRKYMYPKNKTDVEYESDEKARGTRLDGL   250

251  DLVDTWKSFKPRYKHSHFIWNRTELLTLDPHNVDYLLG              288
     |||||||||||||:|||||||||||||||||||||||
251  DLVDTWKSFKPRHKHSHFIWNRTELLTLDPHNVDYLLG              288
```

Sequence name: /tmp/H6G7vkGMmy/rS1jwUOCll: AAH21289

Alignment:

```
  1  MISPFLVLAIGTCLTNSLVPEKEKDPKYWRDQAQETLKYALELQKLNTNV    50
     ||||||||||||||||||||||||||||||||||||||||||||||||||
 63  MISPFLVLAIGTCLTNSLVPEKEKDPKYWRDQAQETLKYALELQKLNTNV   112

51  AKNVIMFLGDGMGVSTVTAARILKGQLHHNPGEETRLEMDKFPFVALSKT   100
     ||||||||||||||||||||||||||||||||||||||||||||||||||
113  AKNVIMFLGDGMGVSTVTAARILKGQLHHNPGEETRLEMDKFPFVALSKT   162

101  YNTNAQVPDSAGTATAYLCGVKANEGTVGVSAATERSRCNTTQGNEVTSI   150
     ||||||||||||||||||||||||||||||||||||||||||||||||||
163  YNTNAQVPDSAGTATAYLCGVKANEGTVGVSAATERSRCNTTQGNEVTSI   212
```

-continued

```
151  LRWAKDAGKSVGIVTTTRVNHATPSAAYAHSADRDWYSDNEMPPEALSQG  200
     ||||||||||||||||||||||||||||||||||||||||||||||||||
213  LRWAKDAGKSVGIVTTTRVNHATPSAAYAHSADRDWYSDNEMPPEALSQG  262

201  CKDIAYQLMHNIRDIDVIMGGGRKYMYPKNKTDVEYESDEKARGTRLDGL  250
     ||||||||||||||||||||||||||||||||||||||||||||||||||
263  CKDIAYQLMHNIRDIDVIMGGGRKYMYPKNKTDVEYESDEKARGTRLDGL  312

251  DLVDTWKSFKPRYKHSHFIWNRTELLTLDPHNVDYLLG             288
     |||||||||||||||||||||||||||||||||||||
313  DLVDTWKSFKPRYKHSHFIWNRTELLTLDPHNVDYLLG             350
```

Sequence name: /tmp/H6G7vkGMmy/rS1jwUOCll:O75090 (SEQ ID NO: 958)

Sequence documentation:

Alignment of: HSAPHOL_P8 (SEQ ID NO: 43) x O75090 (SEQ ID NO: 958) . . .

Alignment segment 1/1:
  Quality: 2830.00

Escore: 0
  Matching length: 288 Total length: 288
  Matching Percent Similarity: 100.00 Matching Percent Identity: 100.00
  Total Percent Similarity: 100.00 Total Percent Identity: 100.00
  Gaps: 0

Alignment:

```
  1  MISPFLVLAIGTCLTNSLVPEKEKDPKYWRDQAQETLKYALELQKLNTNV   50
     ||||||||||||||||||||||||||||||||||||||||||||||||||
  1  MISPFLVLAIGTCLTNSLVPEKEKDPKYWRDQAQETLKYALELQKLNTNV   50

51  AKNVIMFLGDGMGVSTVTAARILKGQLHHNPGEETRLEMDKFPFVALSKT  100
     ||||||||||||||||||||||||||||||||||||||||||||||||||
 51  AKNVIMFLGDGMGVSTVTAARILKGQLHHNPGEETRLEMDKFPFVALSKT  100

101  YNTNAQVPDSAGTATAYLCGVKANEGTVGVSAATERSRCNTTQGNEVTSI  150
     ||||||||||||||||||||||||||||||||||||||||||||||||||
101  YNTNAQVPDSAGTATAYLCGVKANEGTVGVSAATERSRCNTTQGNEVTSI  150

151  LRWAKDAGKSVGIVTTTRVNHATPSAAYAHSADRDWYSDNEMPPEALSQG  200
     ||||||||||||||||||||||||||||||||||||||||||||||||||
151  LRWAKDAGKSVGIVTTTRVNHATPSAAYAHSADRDWYSDNEMPPEALSQG  200

201  CKDIAYQLMHNIRDIDVIMGGGRKYMYPKNKTDVEYESDEKARGTRLDGL  250
     ||||||||||||||||||||||||||||||||||||||||||||||||||
201  CKDIAYQLMHNIRDIDVIMGGGRKYMYPKNKTDVEYESDEKARGTRLDGL  250

251  DLVDTWKSFKPRYKHSHFIWNRTELLTLDPHNVDYLLG             288
     |||||||||||||||||||||||||||||||||||||
251  DLVDTWKSFKPRYKHSHFIWNRTELLTLDPHNVDYLLG             288
```

DESCRIPTION FOR CLUSTER T10888

Cluster T10888 features 4 transcript(s) and 8 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| T10888_PEA_1_T1 | 44 |
| T10888_PEA_1_T4 | 45 |
| T10888_PEA_1_T5 | 46 |
| T10888_PEA_1_T6 | 47 |

TABLE 2

Segments of interest

| Segment Name | SEQ ID NO: |
|---|---|
| T10888_PEA_1_node_11 | 48 |
| T10888_PEA_1_node_12 | 49 |
| T10888_PEA_1_node_17 | 50 |

TABLE 2-continued

Segments of interest

| Segment Name | SEQ ID NO: |
|---|---|
| T10888_PEA_1_node_4 | 51 |
| T10888_PEA_1_node_6 | 52 |
| T10888_PEA_1_node_7 | 53 |

TABLE 2-continued

Segments of interest

| Segment Name | SEQ ID NO: |
|---|---|
| T10888_PEA_1_node_9 | 54 |
| T10888_PEA_1_node_15 | 55 |

TABLE 3

Proteins of interest

| Protein Name | SEQ ID NO: |
|---|---|
| T10888_PEA_1_P2 | 57 |
| T10888_PEA_1_P4 | 58 |
| T10888_PEA_1_P5 | 59 |
| T10888_PEA_1_P6 | 60 |

These sequences are variants of the known protein Carcinoembryonic antigen-related cell adhesion molecule 6 precursor (SwissProt accession identifier CEA6_HUMAN; known also according to the synonyms Normal cross-reacting antigen; Nonspecific crossreacting antigen; CD66c antigen), SEQ ID NO:56, referred to herein as the previously known protein.

The sequence for protein Carcinoembryonic antigen-related cell adhesion molecule 6 precursor is given at the end of the application, as "Carcinoembryonic antigen-related cell adhesion molecule 6 precursor amino acid sequence". Known polymorphisms for this sequence are as shown in Table 4.

TABLE 4

Amino acid mutations for Known Protein

| SNP position(s) on amino acid sequence | Comment |
|---|---|
| 138 | F -> L |
| 239 | V -> G |

Protein Carcinoembryonic antigen-related cell adhesion molecule 6 precursor localization is believed to be attached to the membrane by a GPI-anchor.

The previously known protein also has the following indication(s) and/or potential therapeutic use(s): Cancer. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Immunostimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Imaging agent; Anticancer; Immunostimulant; Immunoconjugate; Monoclonal antibody, murine; Antisense therapy; antibody.

The following GO Annotation(s) apply to the previously known protein. The following annotation(s) were found: signal transduction; cell-cell signaling, which are annotation(s) related to Biological Process; and integral plasma membrane protein, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster T10888 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 9 refer to weighted expression of ESTs in each category, as "parts per million" (ratio of the expression of ESTs for a particular cluster to the expression of all ESTs in that category, according to parts per million).

Figure 9:
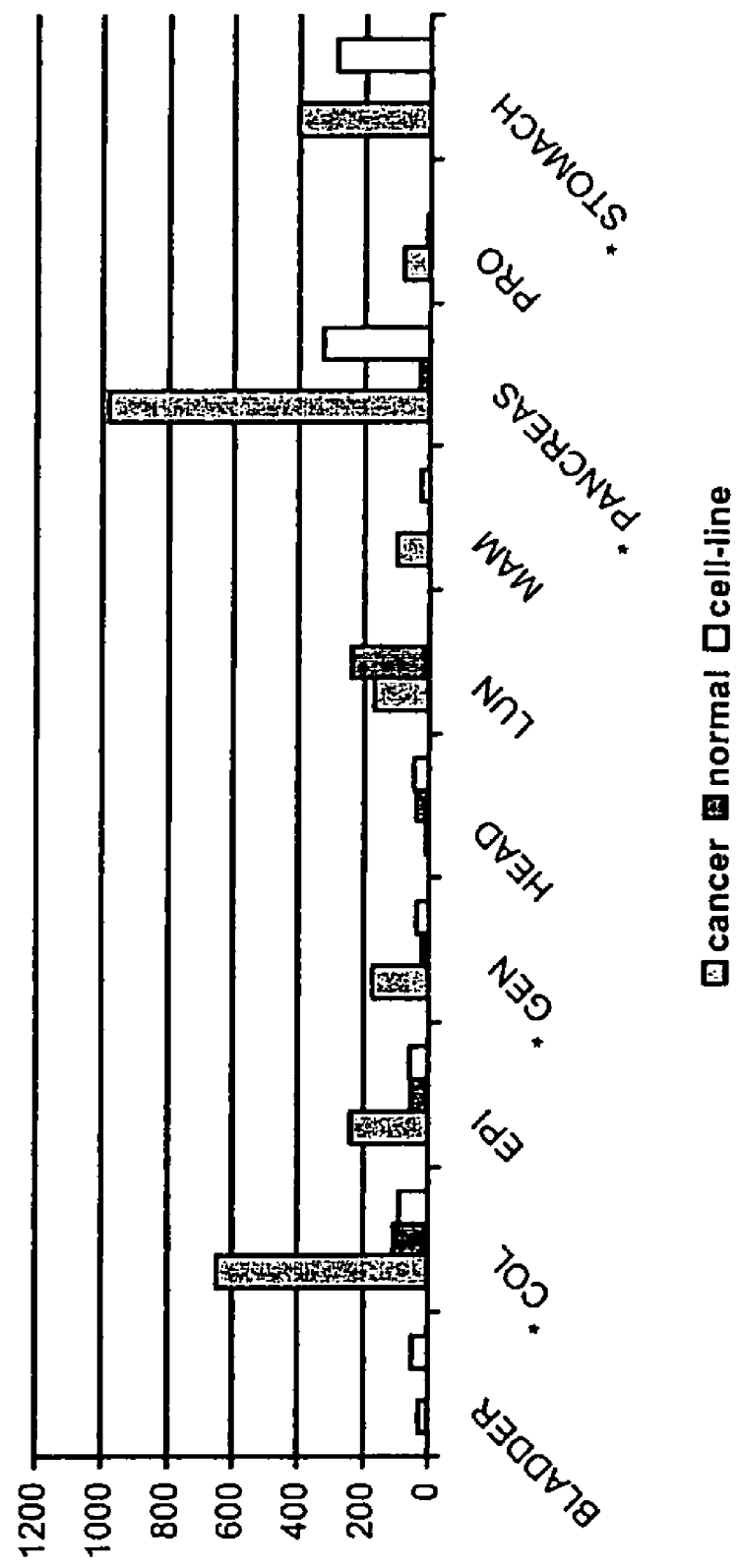
FIG. 9 shows cancer and cell-line vs. normal tissue expression.

Overall, the following results were obtained as shown with regard to the histograms in FIG. 9 and Table 5. This cluster is overexpressed (at least at a minimum level) in the following pathological conditions: colorectal cancer, a mixture of malignant tumors from different tissues, pancreas carcinoma and gastric carcinoma.

TABLE 5

Normal tissue distribution

| Name of Tissue | Number |
|---|---|
| bladder | 0 |
| colon | 107 |
| epithelial | 52 |
| general | 22 |
| head and neck | 40 |
| lung | 237 |
| breast | 0 |
| pancreas | 32 |
| prostate | 12 |
| stomach | 0 |

TABLE 6

P values and ratios for expression in cancerous tissue

| Name of Tissue | P1 | P2 | SP1 | R3 | SP2 | R4 |
|---|---|---|---|---|---|---|
| bladder | 5.4e-01 | 3.4e-01 | 5.6e-01 | 1.8 | 4.6e-01 | 1.9 |
| colon | 1.2e-01 | 1.7e-01 | 2.8e-05 | 3.7 | 7.9e-04 | 2.8 |
| epithelial | 3.3e-02 | 2.1e-01 | 2.8e-20 | 2.8 | 4.8e-10 | 1.9 |
| general | 3.3e-05 | 2.2e-03 | 1.9e-44 | 4.9 | 4.6e-27 | 3.3 |
| head and neck | 4.6e-01 | 4.3e-01 | 1 | 0.8 | 7.5e-01 | 1.0 |
| lung | 7.6e-01 | 8.2e-01 | 8.9e-01 | 0.6 | 1 | 0.3 |
| breast | 3.7e-02 | 4.1e-02 | 1.5e-01 | 3.3 | 3.1e-01 | 2.4 |
| pancreas | 2.6e-01 | 2.4e-01 | 8.6e-23 | 2.8 | 1.5e-19 | 4.5 |
| prostate | 9.1e-01 | 9.3e-01 | 4.1e-02 | 1.2 | 1.0e-01 | 1.0 |
| stomach | 4.5e-02 | 5.6e-02 | 5.1e-04 | 4.1 | 4.7e-04 | 6.3 |

As noted above, cluster T10888 features 4 transcript(s), which were listed in Table 1 above. These transcript(s) encode for protein(s) which are variant(s) of protein Carcinoembryonic antigen-related cell adhesion molecule 6 precursor. A description of each variant protein according to the present invention is now provided.

Variant protein T10888_PEA_1_P2 (SEQ ID NO: 57) according to the present invention has an amino acid sequence as given at the end of the application; it is encoded by transcript(s) T10888_PEA_1_T1 (SEQ ID NO: 44). An alignment is given to the known protein (Carcinoembryonic antigen-related cell adhesion molecule 6 precursor) at the end of the application. One or more alignments to one or more previously published protein sequences are given at the end of the application. A brief description of the relationship of the variant protein according to the present invention to each such aligned protein is as follows:

Comparison report between T10888_PEA_1_P2 (SEQ ID NO: 57) and CEA6_HUMAN:

1. An isolated chimeric polypeptide encoding for T10888_PEA_1_P2 (SEQ ID NO: 57), comprising a first amino acid sequence being at least 90% homologous to MGPPSAPPCRLHVPWKEVLLTASLLTF-WNPPTTAKLTIESTPFNVAEGKEVLLLAHNLP QNRI-GYSWYKGERVDGNSLIVGYVIGTQQAT-PGPAYSGRETIYPNASLLIQNVTQNDTG FYTLQVIKSDLVNEEATGQFHVYPELP-KPSISSNNSNPVEDKDAVAFTCEPEVQNTTYL WWVNGQSLPVSPRLQLSNGNMTLTLLS-VKRNDAGSYECEIQNPASANRSDPVTLNVLY GPDVP-TISPSKANYRPGENLNLSCHAASNP-PAQYSWFINGTFQQSTQELFIPNITVNNSGS YMCQAHNSATGLNRTTVTMITVS corresponding to amino acids 1-319 of CEA6_HUMAN, which also corresponds to amino acids 1-319 of T10888_PEA_1_P2 (SEQ ID NO: 57), and a second amino acid sequence being at least 70%, optionally at least 80%, preferably at least 85%, more preferably at least 90% and most preferably at least 95% homologous to a polypeptide having the sequence DWTRP (SEQ ID NO: 1114) corresponding to amino acids 320-324 of T10888_PEA_1_P2 (SEQ ID NO: 57), wherein said first and second amino acid sequences are contiguous and in a sequential order.

2. An isolated polypeptide encoding for a tail of T10888_PEA_1_P2 (SEQ ID NO: 57), comprising a polypeptide being at least 70%, optionally at least about 80%, preferably at least about 85%, more preferably at least about 90% and most preferably at least about 95% homologous to the sequence DWTRP (SEQ ID NO: 1114) in T10888_PEA_1_P2 (SEQ ID NO: 57).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T10888_PEA_1_P2 (SEQ ID NO: 57) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein T10888_PEA_1_P2 (SEQ ID NO: 57) sequence provides support for the deduced sequence of this variant protein according to the present invention).

TABLE 7

Amino acid mutations

| SNP position(s) on amino acid sequence | Alternative amino acid(s) | Previously known SNP? |
|---|---|---|
| 13 | V -> | No |
| 232 | N -> D | No |
| 324 | P -> | No |

TABLE 7-continued

Amino acid mutations

| SNP position(s) on amino acid sequence | Alternative amino acid(s) | Previously known SNP? |
|---|---|---|
| 63 | I -> | No |
| 92 | G -> | No |

Variant protein T10888_PEA_1_P2 (SEQ ID NO: 57) is encoded by the following transcript(s): T10888_PEA_1_T1 (SEQ ID NO: 44), for which the sequence(s) is/are given at the end of the application. The coding portion of transcript T10888_PEA_1_T1 (SEQ ID NO: 44) is shown in bold; this coding portion starts at position 151 and ends at position 1122. The transcript also has the following SNPs as listed in Table 8 (given according to their position on the nucleotide sequence, with the alternative nucleic acid listed; the last column indicates whether the SNP is known or not; the presence of known SNPs in variant protein T10888_PEA_1_P2 (SEQ ID NO: 57) sequence provides support for the deduced sequence of this variant protein according to the present invention).

TABLE 8

Nucleic acid SNPs

| SNP position on nucleotide sequence | Alternative nucleic acid | Previously known SNP? |
|---|---|---|
| 119 | C -> T | No |
| 120 | A -> T | No |
| 1062 | A -> G | Yes |
| 1120 | C -> | No |
| 1297 | G -> T | Yes |
| 1501 | A -> G | Yes |
| 1824 | G -> A | No |
| 2036 | A -> C | No |
| 2036 | A -> G | No |
| 2095 | A -> C | No |
| 2242 | A -> C | No |
| 2245 | A -> C | No |
| 189 | C -> | No |
| 2250 | A -> T | Yes |
| 2339 | C -> A | Yes |
| 276 | G -> A | Yes |
| 338 | T -> | No |
| 424 | G -> | No |
| 546 | A -> G | No |
| 702 | C -> T | No |
| 844 | A -> G | No |
| 930 | C -> T | Yes |

Variant protein T10888_PEA_1_P4 (SEQ ID NO: 58) according to the present invention has an amino acid sequence as given at the end of the application; it is encoded by transcript(s) T10888_PEA_1_T4 (SEQ ID NO: 45). An alignment is given to the known protein (Carcinoembryonic antigen-related cell adhesion molecule 6 precursor) at the end of the application. One or more alignments to one or more previously published protein sequences are given at the end of the application. A brief description of the relationship of the variant protein according to the present invention to each such aligned protein is as follows:

Comparison report between T10888_PEA_1_P4 (SEQ ID NO: 58) and CEA6_HUMAN:

1. An isolated chimeric polypeptide encoding for T10888_PEA_1_P4 (SEQ ID NO: 58), comprising a first amino acid sequence being at least 90% homologous to MGPPSAPPCRLHVPWKEVLLTASLLTF- WNPPTTAKLTIESTPFNVAEGKEVLLLAHNLP QNRI-GYSWYKGERVDGNSLIVGYVIGTQQAT-PGPAYSGRETIYPNASLLIQNVTQNDTG FYTLQVIKSDLVNEEATGQFHVYPELP-KPSISSNNSNPVEDKDAVAFTCEPEVQNTTYL WWVNGQSLPVSPRLQLSNGNMTLTLLS-VKRNDAGSYECEIQNPASANRSDPVTLNVL corresponding to amino acids 1-234 of CEA6_HUMAN, which also corresponds to amino acids 1-234 of T10888_PEA_1_P4 (SEQ ID NO: 58), and a second amino acid sequence being at least 70%, optionally at least 80%, preferably at least 85%, more preferably at least 90% and most preferably at least 95% homologous to a polypeptide having the sequence LLLSSQLWPPSASRLECWPGWL (SEQ ID NO: 1115) corresponding to amino acids 235-256 of T10888_PEA_1_P4 (SEQ ID NO: 58), wherein said first and second amino acid sequences are contiguous and in a sequential order.

2. An isolated polypeptide encoding for a tail of T10888_PEA_1_P4 (SEQ ID NO: 58), comprising a polypeptide being at least 70%, optionally at least about 80%, preferably at least about 85%, more preferably at least about 90% and most preferably at least about 95% homologous to the sequence LLLSSQLWPPSASRLECWPGWL (SEQ ID NO: 1115) in T10888_PEA_1_P4 (SEQ ID NO: 58).

Comparison report between T10888_PEA_1_P4 (SEQ ID NO: 58) and Q13774 (SEQ ID NO: 959) (SEQ NO:959):

1. An isolated chimeric polypeptide encoding for T10888_PEA_1_P4 (SEQ ID NO: 58), comprising a first amino acid sequence being at least 90% homologous to MGPPSAPPCRLHVPWKEVLLTASLLTF-WNPPTTAKLTIESTPFNVAEGKEVLLLAHNLP QNRI-GYSWYKGERVDGNSLIVGYVIGTQQAT-PGPAYSGRETIYPNASLLIQNVTQNDTG FYTLQVIKSDLVNEEATGQFHVYPELP-KPSISSNNSNPVEDKDAVAFTCEPEVQNTTYL WWVNGQSLPVSPRLQLSNGNMTLTLLS-VKRNDAGSYECEIQNPASANRSDPVTLNVL corresponding to amino acids 1-234 of Q13774 (SEQ ID NO: 959), which also corresponds to amino acids 1-234 of T10888_PEA_1_P4 (SEQ ID NO: 58), and a second amino acid sequence being at least 70%, optionally at least 80%, preferably at least 85%, more preferably at least 90% and most preferably at least 95% homologous to a polypeptide having the sequence LLLSSQLWPPSASRLECWPGWL (SEQ ID NO: 1115) corresponding to amino acids 235-256 of T10888_PEA_1_P4 (SEQ ID NO: 58), wherein said first and second amino acid sequences are contiguous and in a sequential order.

2. An isolated polypeptide encoding for a tail of T10888_PEA_1_P4 (SEQ ID NO: 58), comprising a polypeptide being at least 70%, optionally at least about 80%, preferably at least about 85%, more preferably at least about 90% and most preferably at least about 95% homologous to the sequence LLLSSQLWPPSASRLECWPGWL (SEQ ID NO: 1115) in T10888_PEA_1_P4 (SEQ ID NO: 58).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T10888_PEA_1_P4 (SEQ ID NO: 58) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein T10888_PEA_1_P4 (SEQ ID NO: 58) sequence provides support for the deduced sequence of this variant protein according to the present invention).

TABLE 9

Amino acid mutations

| SNP position(s) on amino acid sequence | Alternative amino acid(s) | Previously known SNP? |
|---|---|---|
| 13 | V -> | No |
| 232 | N -> D | No |
| 63 | I -> | No |
| 92 | G -> | No |

Variant protein T10888_PEA_1_P4 (SEQ ID NO: 58) is encoded by the following transcript(s): T10888_PEA_1_T4 (SEQ ID NO: 45), for which the sequence(s) is/are given at the end of the application. The coding portion of transcript T10888_PEA_1_T4 (SEQ ID NO: 45) is shown in bold; this coding portion starts at position 151 and ends at position 918'. The transcript also has the following SNPs as listed in Table 10 (given according to their position on the nucleotide sequence, with the alternative nucleic acid listed; the last column indicates whether the SNP is known or not; the presence of known SNPs in variant protein T10888_PEA_1_P4 (SEQ ID NO: 58) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 119 | C -> T | No |
| 120 | A -> T | No |
| 978 | C -> | No |
| 1155 | G -> T | Yes |
| 1359 | A -> G | Yes |
| 1682 | G -> A | No |
| 1894 | A -> C | No |
| 1894 | A -> G | No |
| 1953 | A -> C | No |
| 2100 | A -> C | No |
| 2103 | A -> C | No |
| 2108 | A -> T | Yes |
| 189 | C -> | No |
| 2197 | C -> A | Yes |
| 276 | G -> A | Yes |
| 338 | T -> | No |
| 424 | G -> | No |
| 546 | A -> G | No |
| 702 | C -> T | No |
| 844 | A -> G | No |
| 958 | G -> | No |

Variant protein T10888_PEA_1_P5 (SEQ ID NO: 59) according to the present invention has an amino acid sequence as given at the end of the application; it is encoded by transcript(s) T10888_PEA_1_T5 (SEQ ID NO: 46). An alignment is given to the known protein (Carcinoembryonic antigen-related cell adhesion molecule 6 precursor) at the end of the application. One or more alignments to one or more previously published protein sequences are given at the end of the application. A brief description of the relationship of the variant protein according to the present invention to each such aligned protein is as follows:

Comparison report between T10888_PEA_1_P5 (SEQ ID NO: 59) and CEA6_HUMAN:

1. An isolated chimeric polypeptide encoding for T10888_PEA_1_P5 (SEQ ID NO: 59), comprising a first amino acid sequence being at least 90% homologous to MGPPSAPPCRLHVPWKEVLLTASLLTF-WNPPTTAKLTIESTPFNVAEGKEVLLLAHNLP QNRI-GYSWYKGERVDGNSLIVGYVIGTQQAT-PGPAYSGRETIYPNASLLIQNVTQNDTG FYTLQVIKSDLVNEEATGQFHVYPELP-KPSISSNNSNPVEDKDAVAFTCEPEVQNTTYL WWVNGQSLPVSPRLQLSNGNMTLTLLS-VKRNDAGSYECEIQNPASANRSDPVTLNVLY GPDVP-TISPSKANYRPGENLNLSCHAASNP-PAQYSWFINGTFQQSTQELFIPNITVNNSGS YMCQAHNSATGLNRTTVTMITVSG corresponding to amino acids 1-320 of CEA6_HUMAN, which also corresponds to amino acids 1-320 of T10888_PEA_1_P5 (SEQ ID NO: 59), and a second amino acid sequence being at least 70%, optionally at least 80%, preferably at least 85%, more preferably at least 90% and most preferably at least 95% homologous to a polypeptide having the sequence KWI-HEALASHFQVESGSQRRARKKFSF-PTCVQGAHANPKFSPEPSQFTSADSFPLVFLFF VVFC-FLISHV (SEQ ID NO: 1116) corresponding to amino acids 321-390 of T10888_PEA_1_P5 (SEQ ID NO: 59), wherein said first and second amino acid sequences are contiguous and in a sequential order.

2. An isolated polypeptide encoding for a tail of T10888_PEA_1_P5 (SEQ ID NO: 59), comprising a polypeptide being at least 70%, optionally at least about 80%, preferably at least about 85%, more preferably at least about 90% and most preferably at least about 95% homologous to the sequence KWIHEALASHFQVESGSQRRARKKFSF-PTCVQGAHANPKFSPEPSQFTSADSFPLVFLFF VVFC-FLISHV (SEQ ID NO: 1116) in T10888_PEA_1_P5 (SEQ ID NO: 59).

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a transmembrane region downstream of this signal peptide.

Variant protein T10888_PEA_1_P5 (SEQ ID NO: 59) also has the following non-silent SNPs (Single Nucleotide Polymorphisms) as listed in Table 11, (given according to their position(s) on the amino acid sequence, with the alternative amino acid(s) listed; the last column T10888_PEA_1_P5 (SEQ ID NO: 59) sequence provides support for the deduced sequence of this variant protein according to the present invention).

TABLE 11

Amino acid mutations

| SNP position(s) on amino acid sequence | Alternative amino acid(s) | Previously known SNP? |
|---|---|---|
| 13 | V -> | No |
| 232 | N -> D | No |
| 63 | I -> | No |
| 92 | G -> | No |

Variant protein T10888_PEA_1_P5 (SEQ ID NO: 59) is encoded by the following transcript(s): T10888_PEA_1_T5 (SEQ ID NO: 46), for which the sequence(s) is/are given at the end of the application. The coding portion of transcript T10888_PEA_1_T5 (SEQ ID NO: 46) is shown in bold; this coding portion starts at position 151 and ends at position 1320. The transcript also has the following SNPs as listed in Table 12 (given according to their position on the nucleotide sequence, with the alternative nucleic acid listed; the last column indicates whether the SNP is known or not; the presence of known SNPs in variant protein T10888_PEA_1_P5 (SEQ ID NO: 59) sequence provides support for the deduced sequence of this variant protein according to the present invention).

TABLE 12

Nucleic acid SNPs

| SNP position on nucleotide sequence | Alternative nucleic acid | Previously known SNP? |
|---|---|---|
| 119 | C -> T | No |
| 120 | A -> T | No |
| 1062 | A -> G | Yes |
| 1943 | C -> A | Yes |
| 2609 | C -> T | Yes |
| 2647 | C -> G | No |
| 2701 | C -> T | Yes |
| 2841 | T -> C | Yes |
| 189 | C -> | No |
| 276 | G -> A | Yes |
| 338 | T -> | No |
| 424 | G -> | No |
| 546 | A -> G | No |
| 702 | C -> T | No |
| 844 | A -> G | No |
| 930 | C -> T | Yes |

Variant protein T10888_PEA_1_P6 (SEQ ID NO: 60) according to the present invention has an amino acid sequence as given at the end of the application; it is encoded by transcript(s) T10888_PEA_1_T6 (SEQ ID NO: 47). An alignment is given to the known protein (Carcinoembryonic antigen-related cell adhesion molecule 6 precursor) at the end of the application. One or more alignments to one or more previously published protein sequences are given at the end of the application.

Comparison report between T10888_PEA_1_P6 (SEQ ID NO: 60) and CEA6_HUMAN:

1. An isolated chimeric polypeptide encoding for T10888_PEA_1_P6 (SEQ ID NO: 60), comprising a first amino acid sequence being at least 90% homologous to MGPPSAPPCRLHVPWKEVLLTASLLTF-WNPPTTAKLTIESTPFNVAEGKEVLLLA HNLPQNRI-GYSWYKGERVDGNSLIVGYVIGTQQAT-PGPAYSGRETIYPNASLLIQNVTQ NDTGFYTLQVIKSDLVNEEATGQFHVY corresponding to amino acids 1-141 of CEA6_HUMAN, which also corresponds to amino acids 1-141 of T10888_PEA_1_P6 (SEQ ID NO: 60), and a second amino acid sequence being at least 70%, optionally at least 80%, preferably at least 85%, more preferably at least 90% and most preferably at least 95% homologous to a polypeptide having the sequence REYFH-MTSGCWGSVLLPTYGIVRPGLCLWPSLHYILYQGLDI (SEQ ID NO: 1117)

corresponding to amino acids 142-183 of T10888_PEA_1_P6 (SEQ ID NO: 60), wherein said first and second amino acid sequences are contiguous and in a sequential order.

2. An isolated polypeptide encoding for a tail of T10888_PEA_1_P6 (SEQ ID NO: 60), comprising a polypeptide being at least 70%, optionally at least about 80%, preferably at least about 85%, more preferably at least about 90% and most preferably at least about 95% homologous to the sequence REYFHMTSGCWGSVLLPTYGIVR-PGLCLWPSLHYILYQGLDI (SEQ ID NO: 1117) in T10888_PEA_1_P6 (SEQ ID NO: 60).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T10888_PEA_1_P6 (SEQ ID NO: 60) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein T10888_PEA_1_P6 (SEQ ID NO: 60) sequence provides support for the deduced sequence of this variant protein according to the present invention).

TABLE 13

Amino acid mutations

| SNP position(s) on amino acid sequence | Alternative amino acid(s) | Previously known SNP? |
|---|---|---|
| 13 | V -> | No |
| 63 | I -> | No |
| 92 | G -> | No |

Variant protein T10888_PEA_1_P6 (SEQ ID NO: 60) is encoded by the following transcript(s): T10888_PEA_1_T6 (SEQ ID NO: 47), for which the sequence(s) is/are given at the end of the application. The coding portion of transcript T10888_PEA_1_T6 (SEQ ID NO: 47) is shown in bold; this coding portion starts at position 151 and ends at position 699. The transcript also has the following SNPs as listed in Table 14 (given according to their position on the nucleotide sequence, with the alternative nucleic acid listed; the last column indicates whether the SNP is known or not; the presence of known SNPs in variant protein T10888_PEA_1_P6 (SEQ ID NO: 60) sequence provides support for the deduced sequence of this variant protein according to the present invention).

TABLE 14

Nucleic acid SNPs

| SNP position on nucleotide sequence | Alternative nucleic acid | Previously known SNP? |
|---|---|---|
| 119 | C -> T | No |
| 120 | A -> T | No |
| 189 | C -> | No |
| 276 | G -> A | Yes |
| 338 | T -> | No |
| 424 | G -> | No |
| 546 | A -> G | No |

As noted above, cluster T10888 features 8 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T10888_PEA_1_node_11 (SEQ ID NO: 48) according to the present invention is supported by 57 libraries. The number of libraries was determined as previously described. This segment can be found in the following transcript(s): T10888_PEA_1_T1 (SEQ ID NO: 44) and T10888_PEA_1_T5 (SEQ ID NO: 46). Table 15 below describes the starting and ending position of this segment on each transcript.

TABLE 15

Segment location on transcripts

| Transcript name | Segment starting position | Segment ending position |
|---|---|---|
| T10888_PEA_1_T1 (SEQ ID NO: 44) | 854 | 1108 |
| T10888_PEA_1_T5 (SEQ ID NO: 46) | 854 | 1108 |

Segment cluster T10888_PEA_1_node_12 (SEQ ID NO: 49) according to the present invention is supported by 9 libraries. The number of libraries was determined as previously described. This segment can be found in the following transcript(s): T10888_PEA_1_T5 (SEQ ID NO: 46). Table 16 below describes the starting and ending position of this segment on each transcript.

TABLE 16

Segment location on transcripts

| Transcript name | Segment starting position | Segment ending position |
|---|---|---|
| T10888_PEA_1_T5 (SEQ ID NO: 46) | 1109 | 3004 |

Segment cluster T10888_PEA_1_node_17 (SEQ ID NO: 50) according to the present invention is supported by 160 libraries. The number of libraries was determined as previously described. This segment can be found in the following transcript(s): T10888_PEA_1_T1 (SEQ ID NO: 44) and T10888_PEA_1_T4 (SEQ ID NO: 45). Table 17 below describes the starting and ending position of this segment on each transcript.

TABLE 17

Segment location on transcripts

| Transcript name | Segment starting position | Segment ending position |
|---|---|---|
| T10888_PEA_1_T1 (SEQ ID NO: 44) | 1109 | 2518 |
| T10888_PEA_1_T4 (SEQ ID NO: 45) | 967 | 2376 |

Segment cluster T10888_PEA_1_node_4 (SEQ ID NO: 51) according to the present invention is supported by 61 libraries. The number of libraries was determined as previously described. This segment can be found in the following transcript(s): T10888_PEA_1_T1 (SEQ ID NO: 44), T10888_PEA_1_T4 (SEQ ID NO: 45), T10888_PEA_1_T5 (SEQ ID NO: 46) and T10888_PEA_1_T6 (SEQ ID NO: 47). Table 18 below describes the starting and ending position of this segment on each transcript.

TABLE 18

Segment location on transcripts

| Transcript name | Segment starting position | Segment ending position |
|---|---|---|
| T10888_PEA_1_T1 (SEQ ID NO: 44) | 1 | 214 |
| T10888_PEA_1_T4 (SEQ ID NO: 45) | 1 | 214 |
| T10888_PEA_1_T5 (SEQ ID NO: 46) | 1 | 214 |
| T10888_PEA_1_T6 (SEQ ID NO: 47) | 1 | 214 |

Segment cluster T10888_PEA_1_node_6 (SEQ ID NO: 52) according to the present invention is supported by 81 libraries. The number of libraries was determined as previously described. This segment can be found in the following transcript(s): T10888_PEA_1_T1 (SEQ ID NO: 44), T10888_PEA_1_T4 (SEQ ID NO: 45), T10888_PEA_1_T5 (SEQ ID NO: 46) and T10888_PEA_1_T6 (SEQ ID NO: 47). Table 19 below describes the starting and ending position of this segment on each transcript.

TABLE 19

Segment location on transcripts

| Transcript name | Segment starting position | Segment ending position |
|---|---|---|
| T10888_PEA_1_T1 (SEQ ID NO: 44) | 215 | 574 |
| T10888_PEA_1_T4 (SEQ ID NO: 45) | 215 | 574 |
| T10888_PEA_1_T5 (SEQ ID NO: 46) | 215 | 574 |
| T10888_PEA_1_T6 (SEQ ID NO: 47) | 215 | 574 |

Segment cluster T10888_PEA_1_node_7 (SEQ ID NO: 53) according to the present invention is supported by 4 libraries. The number of libraries was determined as previously described. This segment can be found in the following transcript(s): T10888_PEA_1_T6 (SEQ ID NO: 47). Table 20 below describes the starting and ending position of this segment on each transcript.

TABLE 20

Segment location on transcripts

| Transcript name | Segment starting position | Segment ending position |
|---|---|---|
| T10888_PEA_1_T6 (SEQ ID NO: 47) | 575 | 1410 |

Segment cluster T10888_PEA_1_node_9 (SEQ ID NO: 54) according to the present invention is supported by 72 libraries. The number of libraries was determined as previously described. This segment can be found in the following transcript(s): T10888_PEA_1_T1 (SEQ ID NO: 44), T10888_PEA_1_T4 (SEQ ID NO: 45) and T10888_PEA_1_T5 (SEQ ID NO: 46). Table 21 below describes the starting and ending position of this segment on each transcript.

TABLE 21

Segment location on transcripts

| Transcript name | Segment starting position | Segment ending position |
|---|---|---|
| T10888_PEA_1_T1 (SEQ ID NO: 44) | 575 | 853 |
| T10888_PEA_1_T4 (SEQ ID NO: 45) | 575 | 853 |
| T10888_PEA_1_T5 (SEQ ID NO: 46) | 575 | 853 |

According to an optional embodiment of the present invention, short segments related to the above cluster are also provided. These segments are up to about 120 bp in length, and so are included in a separate description.

Segment cluster T10888_PEA_1_node_15 (SEQ ID NO: 55) according to the present invention is supported by 39 libraries. The number of libraries was determined as previously described. This segment can be found in the following transcript(s): T10888_PEA_1_T4 (SEQ ID NO: 45). Table 22 below describes the starting and ending position of this segment on each transcript.

TABLE 22

Segment location on transcripts

| Transcript name | Segment starting position | Segment ending position |
|---|---|---|
| T10888_PEA 1_T4 (SEQ ID NO:45) | 854 | 966 |

Variant protein alignment to the previously known protein:

Sequence name: /tmp/tM4EgaoKvm/vuztUrlRc7: CEA6_HUMAN

Sequence documentation:

Alignment of: T10888_PEA_1_P2 (SEQ ID NO: 57) x CEA6_HUMAN . . .

Alignment segment 1/1:
  Quality: 3163.00

Escore: 0
  Matching length: 319 Total length: 319

Matching Percent Similarity: 100.00 Matching Percent

Identity: 100.00

Total Percent Similarity: 100.00 Total Percent Identity: 100.00

Gaps: 0

Alignment:

```
  1  MGPPSAPPCRLHVPWKEVLLTASLLTFWNPPTTAKLTIESTPFNVAEGKE   50
     ||||||||||||||||||||||||||||||||||||||||||||||||||
  1  MGPPSAPPCRLHVPWKEVLLTASLLTASLLTFWAKLTIESTPFNVAEGKE   50

51  VLLLAHNLPQNRIGYSWYKGERVDGNSLIVGYVIGTQQATPGPAYSGRET  100
     ||||||||||||||||||||||||||||||||||||||||||||||||||
 51  MGPPSAPPCRLHVPWKEVLLTASLLTASLLTFWNPPTTAKLTIESTPFNV  100

101  IYPNASLLIQNVTQNDTGFYTLQVIKSDLVNEEATGQFHVYPELPKPSIS  150
     ||||||||||||||||||||||||||||||||||||||||||||||||||
101  IYPNASLLIQNVTQNDTGFYTLQVIKSDLVNEEATGQFHVYPELPKPSIS  150

151  SNNSNPVEDKDAVAFTCEPEVQNTTYLWWVNGQSLPVSPRLQLSNGNMTL  200
     ||||||||||||||||||||||||||||||||||||||||||||||||||
151  SNNSNPVEDKDAVAFTCEPEVQNTTYLWWVNGQSLPVSPRLQLSNGNMTL  200

201  TLLSVKRNDAGSYECEIQNPASANRSDPVTLNVLYGPDVPTISPSKANYR  250
     ||||||||||||||||||||||||||||||||||||||||||||||||||
201  TLLSVKRNDAGSYECEIQNPASANRSDPVTLNVLYGPDVPTISPSKANYR  250

251  PGENLNLSCHAASNPPAQYSWFINGTFQQSTQELFIPNITVNNSGSYMCQ  300
     ||||||||||||||||||||||||||||||||||||||||||||||||||
251  PGENLNLSCHAASNPPAQYSWFINGTFQQSTQELFIPNITVNNSGSYMCQ  300

301  AHNSATGLNRTTVTMITVS                                 319
     |||||||||||||||||||
301  AHNSATGLNRTTVTMITVS                                 319
```

Sequence name: /tmp/Yjl1gj7TCe/PgdufzLO1W: CEA6_HUMAN

Sequence documentation:

Alignment of: T10888_PEA_1_P4 (SEQ ID NO: 58) x CEA6_HUMAN ...

Alignment segment 1/1:

Quality: 2310.00

Escore: 0

Matching length: 234 Total length: 234

Matching Percent Similarity: 100.00 Matching Percent Identity: 100.00

Total Percent Similarity: 100.00 Total Percent Identity: 100.00

Gaps: 0

Alignment:

```
  1  MGPPSAPPCRLHVPWKEVLLTASLLTFWNPPTTAKLTIESTPFNVAEGKE   50
     ||||||||||||||||||||||||||||||||||||||||||||||||||
  1  MGPPSAPPCRLHVPWKEVLLTASLLTASLLTFWAKLTIESTPFNVAEGKE   50

51  VLLLAHNLPQNRIGYSWYKGERVDGNSLIVGYVIGTQQATPGPAYSGRET  100
     ||||||||||||||||||||||||||||||||||||||||||||||||||
 51  MGPPSAPPCRLHVPWKEVLLTASLLTASLLTFWNPPTTAKLTIESTPFNV  100

101  IYPNASLLIQNVTQNDTGFYTLQVIKSDLVNEEATGQFHVYPELPKPSIS  150
     ||||||||||||||||||||||||||||||||||||||||||||||||||
101  IYPNASLLIQNVTQNDTGFYTLQVIKSDLVNEEATGQFHVYPELPKPSIS  150

151  SNNSNPVEDKDAVAFTCEPEVQNTTYLWWVNGQSLPVSPRLQLSNGNMTL  200
     ||||||||||||||||||||||||||||||||||||||||||||||||||
151  SNNSNPVEDKDAVAFTCEPEVQNTTYLWWVNGQSLPVSPRLQLSNGNMTL  200

201  TLLSVKRNDAGSYECEIQNPASANRSDPVTLNVL                  234
     |||||||||||||||||||||||||||||||||
201  TLLSVKRNDAGSYECEIQNPASANRSDPVTLNVL                  234
```

Sequence name: /tmp/Yjl1gj7TCe/PgdufzLO1W:Q13774 (SEQ ID NO: 959)

Sequence documentation:

Alignment of: T10888_PEA_1_P4 (SEQ ID NO: 58) x Q13774 (SEQ ID NO: 959) ...

Alignment segment 1/1:

Quality: 2310.00

Escore: 0

Matching length: 234 Total length: 234

Matching Percent Similarity: 100.00 Matching Percent Identity: 100.00

Total Percent Similarity: 100.00 Total Percent Identity: 100.00

Gaps: 0

Alignment:

```
  1  MGPPSAPPCRLHVPWKEVLLTASLLTFWNPPTTAKLTIESTPFNVAEGKE   50
     ||||||||||||||||||||||||||||||||||||||||||||||||||
  1  MGPPSAPPCRLHVPWKEVLLTASLLTASLLTFWAKLTIESTPFNVAEGKE   50

51  VLLLAHNLPQNRIGYSWYKGERVDGNSLIVGYVIGTQQATPGPAYSGRET  100
     ||||||||||||||||||||||||||||||||||||||||||||||||||
 51  MGPPSAPPCRLHVPWKEVLLTASLLTASLLTFWNPPTTAKLTIESTPFNV  100

101  IYPNASLLIQNVTQNDTGFYTLQVIKSDLVNEEATGQFHVYPELPKPSIS  150
     ||||||||||||||||||||||||||||||||||||||||||||||||||
101  IYPNASLLIQNVTQNDTGFYTLQVIKSDLVNEEATGQFHVYPELPKPSIS  150

151  SNNSNPVEDKDAVAFTCEPEVQNTTYLWWVNGQSLPVSPRLQLSNGNMTL  200
     ||||||||||||||||||||||||||||||||||||||||||||||||||
151  SNNSNPVEDKDAVAFTCEPEVQNTTYLWWVNGQSLPVSPRLQLSNGNMTL  200

201  TLLSVKRNDAGSYECEIQNPASANRSDPVTLNVL                 234
     |||||||||||||||||||||||||||||||||
201  TLLSVKRNDAGSYECEIQNPASANRSDPVTLNVL                 234
```

Sequence name: /tmp/x5xDBacdpj/rTXRGepv3y: CEA6_HUMAN

Sequence documentation:

Alignment of: T10888_PEA_1_P5 (SEQ ID NO: 59) x CEA6_HUMAN...

Alignment segment 1/1:

Quality: 3172.00

Escore: 0

Matching length: 320 Total length: 320

Matching Percent Similarity: 100.00 Matching Percent Identity: 100.00

Total Percent Similarity: 100.00 Total Percent Identity: 100.00

Gaps: 0

Alignment:

```
  1  MGPPSAPPCRLHVPWKEVLLTASLLTFWNPPTTAKLTIESTPFNVAEGKE   50
     ||||||||||||||||||||||||||||||||||||||||||||||||||
  1  MGPPSAPPCRLHVPWKEVLLTASLLTASLLTFWAKLTIESTPFNVAEGKE   50

51  VLLLAHNLPQNRIGYSWYKGERVDGNSLIVGYVIGTQQATPGPAYSGRET  100
     ||||||||||||||||||||||||||||||||||||||||||||||||||
 51  MGPPSAPPCRLHVPWKEVLLTASLLTASLLTFWNPPTTAKLTIESTPFNV  100

101  IYPNASLLIQNVTQNDTGFYTLQVIKSDLVNEEATGQFHVYPELPKPSIS  150
     ||||||||||||||||||||||||||||||||||||||||||||||||||
101  IYPNASLLIQNVTQNDTGFYTLQVIKSDLVNEEATGQFHVYPELPKPSIS  150

151  SNNSNPVEDKDAVAFTCEPEVQNTTYLWWVNGQSLPVSPRLQLSNGNMTL  200
     ||||||||||||||||||||||||||||||||||||||||||||||||||
151  SNNSNPVEDKDAVAFTCEPEVQNTTYLWWVNGQSLPVSPRLQLSNGNMTL  200

201  TLLSVKRNDAGSYECEIQNPASANRSDPVTLNVLYGPDVPTISPSKANYR  250
     ||||||||||||||||||||||||||||||||||||||||||||||||||
201  TLLSVKRNDAGSYECEIQNPASANRSDPVTLNVLYGPDVPTISPSKANYR  250

251  PGENLNLSCHAASNPPAQYSWFINGTFQQSTQELFIPNITVNNSGSYMCQ  300
     ||||||||||||||||||||||||||||||||||||||||||||||||||
251  PGENLNLSCHAASNPPAQYSWFINGTFQQSTQELFIPNITVNNSGSYMCQ  300

301  AHNSATGLNRTTVTMITVSG                               320
     ||||||||||||||||||||
301  AHNSATGLNRTTVTMITVSG                               320
```

Sequence name: /tmp/VAhvYFeatq/QNEM573uCo: CEA6_HUMAN

Sequence documentation:

Alignment of: T10888_PEA_1_P6 (SEQ ID NO: 60) x CEA6_HUMAN...

Alignment segment 1/1:
  Quality: 1393.00

Escore: 0
  Matching length: 143 Total length: 143

Matching Percent Similarity: 99.30 Matching Percent

Identity: 99.30
  Total Percent Similarity: 99.30 Total Percent

Identity: 99.30
  Gaps: 0

Alignment:

```
  1 MGPPSAPPCRLHVPWKEVLLTASLLTFWNPPTTAKLTIESTPFNVAEGKE   50
    |||||||||||||||||||||||||| |||||||||||||||||||||||
  1 MGPPSAPPCRLHVPWKEVLLTASLLTASLLTFWAKLTIESTPFNVAEGKE   50

51 VLLLAHNLPQNRIGYSWYKGERVDGNSLIVGYVIGTQQATPGPAYSGRET  100
    |||||||||||||||||||||||||||||||||||||||||||||||||
 51 VLLLAHNLPQNRIGYSWYKGERVDGNSLIVGYVIGTQQATPGPAYSGRET  100

101 IYPNASLLIQNVTQNDTGFYTLQVIKSDLVNEEATGQFHVYRE         143
    ||||||||||||||||||||||||||||||||||||||||||
101 IYPNASLLIQNVTQNDTGFYTLQVIKSDLVNEEATGQFHVYRE         143
```

Alignment of: T10888_PEA_1_P6 (SEQ ID NO: 60) x CEA6_HUMAN...

Alignment segment 1/1:
  Quality: 101.00

Escore: 0
  Matching length: 141 Total length: 183

Matching Percent Similarity: 100.00 Matching Percent

Identity: 100.00
  Total Percent Similarity: 77.05 Total Percent

Identity: 77.05
  Gaps: 1

Alignment:

Expression of CEA6_HUMAN Carcinoembryonic antigen-related cell adhesion molecule 6 T 10888 transcripts which are detectable by amplicon as depicted in sequence name T10888 junc11-17 (SEQ ID NO:962) in normal and cancerous ovary tissues Expression of CEA6_HUMAN Carcinoembryonic antigen-related cell adhesion molecule 6 transcripts detectable by or according to junc11-17, T10888junc11-17 amplicon(s) (SEQ ID NO:962) and T10888junc11-17F (SEQ ID NO:960) and T10888junc11-17R (SEQ ID NO:961) primers was measured by real time PCR. In parallel the expression of four housekeeping genes —PBGD (GenBank Accession No. BC019323, (SEQ ID NO:1036); amplicon—PBGD-amplicon, (SEQ ID NO:1039)), HPRT1 (GenBank Accession No. NM_000194, (SEQ ID NO:1040); amplicon—HPRT1-amplicon, (SEQ ID NO:1043)), and SDHA (GenBank Accession No. NM_004168, (SEQ ID NO:1032); amplicon—SDHA-amplicon, (SEQ ID NO:1035)), GAPDH (GenBank Accession No. BC026907, (SEQ ID NO: 1044); GAPDH amplicon, (SEQ ID NO: 1047)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45-48, 71, Table 1, "Tissue samples in testing panel", above), to obtain a value of fold up-regulation for each sample relative to median of the normal PM samples.

Figure 10:
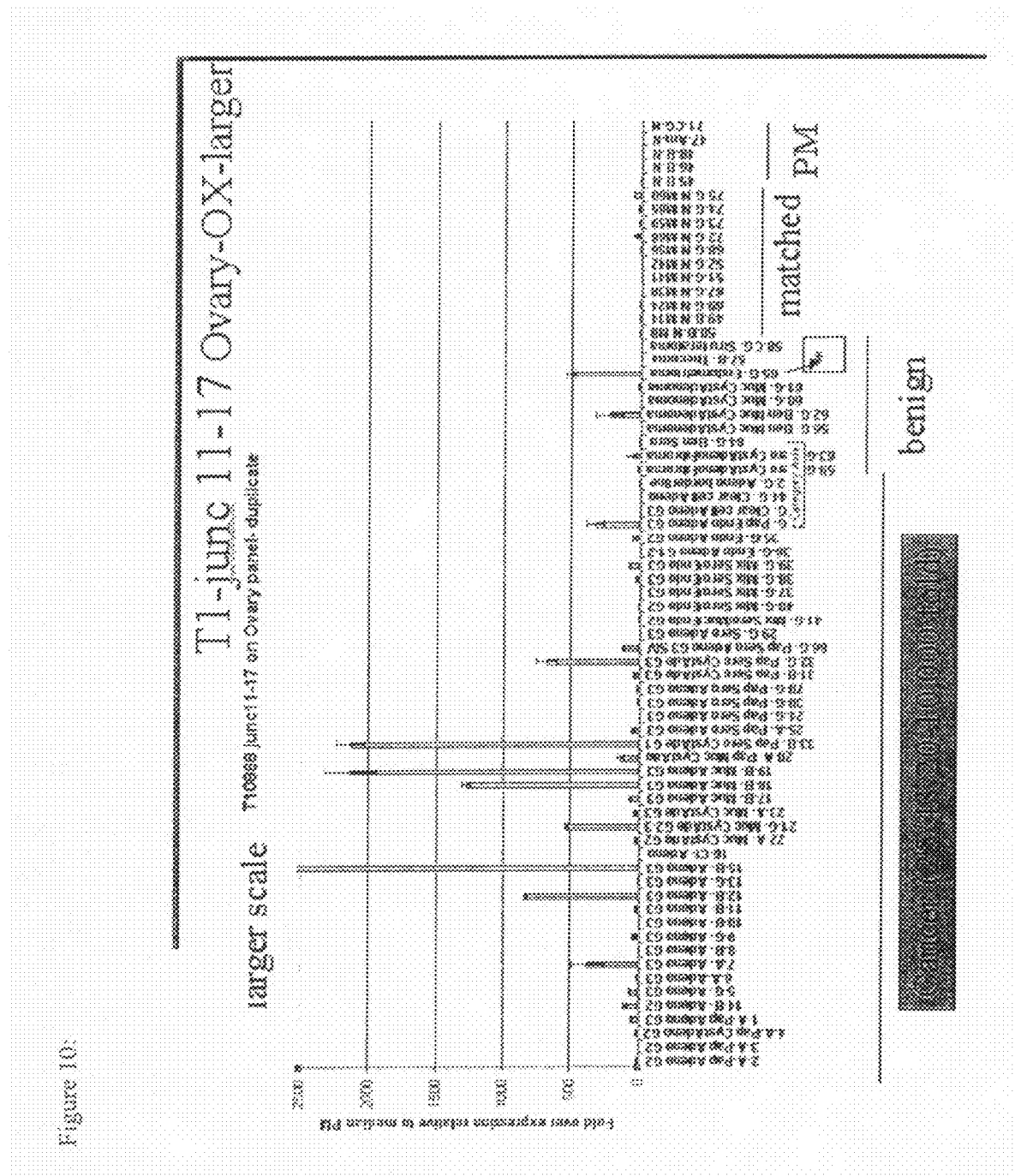
FIG. 10 is a histogram showing over expression of T10888junc11-17 (SEQ ID NO:962) transcripts in cancerous ovary samples relative to the normal samples.

FIG. 10 is a histogram showing over expression of the above-indicated CEA6_HUMAN Carcinoembryonic antigen-related cell adhesion molecule 6 transcripts in cancerous ovary samples relative to the normal samples. Values represent the average of duplicate experiments. Error bars indicate the minimal and maximal values obtained. The number and

```
  1 MGPPSAPPCRLHVPWKEVLLTASLLTFWNPPTTAKLTIESTPFNVAEGKE   50
    |||||||||||||||||||||||||| |||||||||||||||||||||||
  1 MGPPSAPPCRLHVPWKEVLLTASLLTASLLTFWAKLTIESTPFNVAEGKE   50

51 VLLLAHNLPQNRIGYSWYKGERVDGNSLIVGYVIGTQQATPGPAYSGRET  100
    |||||||||||||||||||||||||||||||||||||||||||||||||
 51 VLLLAHNLPQNRIGYSWYKGERVDGNSLIVGYVIGTQQATPGPAYSGRET  100

101 IYPNASLLIQNVTQNDTGFYTLQVIKSDLVNEEATGQFHVYREYFHMTSG  150
    ||||||||||||||||||||||||||||||||||||||||||
101 IYPNASLLIQNVTQNDTGFYTLQVIKSDLVNEEATGQFHVY.........  141

151 CWGSVLLPTYGIVRPGLCLWPSLHYILYQGLDI                   183

141 ................................                   141
``` percentage of samples that exhibit at least 20 fold over-expression, out of the total number of samples tested is indicated in the bottom.

As is evident from FIG. 10, the expression of CEA6_HUMAN Carcinoembryonic antigen-related cell adhesion molecule 6 transcripts detectable by the above amplicon(s) in cancer samples was significantly higher than in the non-cancerous samples (Sample Nos. 45-48, 71, Table 1, "Tissue samples in testing panel") and including benign samples (samples No. 56-65). Notably an over-expression of at least 20 fold was found in 25 out of 43 adenocarcinoma samples.

Statistical analysis was applied to verify the significance of these results, as described below. The P value for the difference in the expression levels of CEA6_HUMAN Carcinoembryonic antigen-related cell adhesion molecule 6 transcripts detectable by the above amplicon(s) in ovary cancer samples versus the normal tissue samples was determined by T test as 3.79E-02.

Threshold of 20 fold overexpression was found to differentiate between cancer and normal samples with P value of 1.97E-02 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: T10888junc11-17F (SEQ ID NO:960) forward primer; and T10888junc11-17R (SEQ ID NO:961) reverse primer.

The present invention also preferably encompasses any amplicon obtained through the use of any suitable primer pair; for example, for the above experiment, the following amplicon was obtained as a non-limiting illustrative example only of a suitable amplicon: T10888junc11-17 (SEQ ID NO:962)

T10888junc11-17F (SEQ ID NO:960)

CCAGCAATCCACACAAGAGCT

T10888junc11-17R (SEQ ID NO:961)

CAGGGTCTGGTCCAATCAGAG

T10888junc11-17 (SEQ ID NO:962)

CCAGCAATCCACACAAGAGCTCTTTATC-
CCCAACATCACTGTGAATAATAGCGGAT CCTATAT-
GTGCCAAGCCCATAACTCAGCCACTGGC-
CTCAATAGGACCACAGTCACG
ATGATCACAGTCTCTGATTGGACCAGACCCTG

Expression of CEA6_HUMAN Carcinoembryonic antigen-related cell adhesion molecule 6 T 10888 transcripts which are detectable by amplicon as depicted in sequence name T10888 junc11-17 (SEQ ID NO:962) in different normal tissues.

Expression of CEA6_HUMAN Carcinoembryonic antigen-related cell adhesion molecule 6 transcripts detectable by or according to T10888 junc11-17 amplicon(s) and T10888 junc11-17F and T10888 junc11-17R was measured by real time PCR. In parallel the expression of four housekeeping genes—RPL19 (GenBank Accession No. NM_000981, (SEQ ID NO:1048); RPL19 amplicon, (SEQ ID NO:1051)), TATA box (GenBank Accession No. NM_003194, (SEQ ID NO:1052); TATA amplicon, (SEQ ID NO:1055)), Ubiquitin (GenBank Accession No. BC000449, (SEQ ID NO: 1056); amplicon—Ubiquitin-amplicon, (SEQ ID NO:1059)) and SDHA (GenBank Accession No. NM_004168, (SEQ ID NO:1032); amplicon—SDHA-amplicon, (SEQ ID NO:1035)) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 2 above, "Tissue samples in normal panel") to obtain a value of relative expression of each sample relative to median of the ovary samples.

Figure 11:
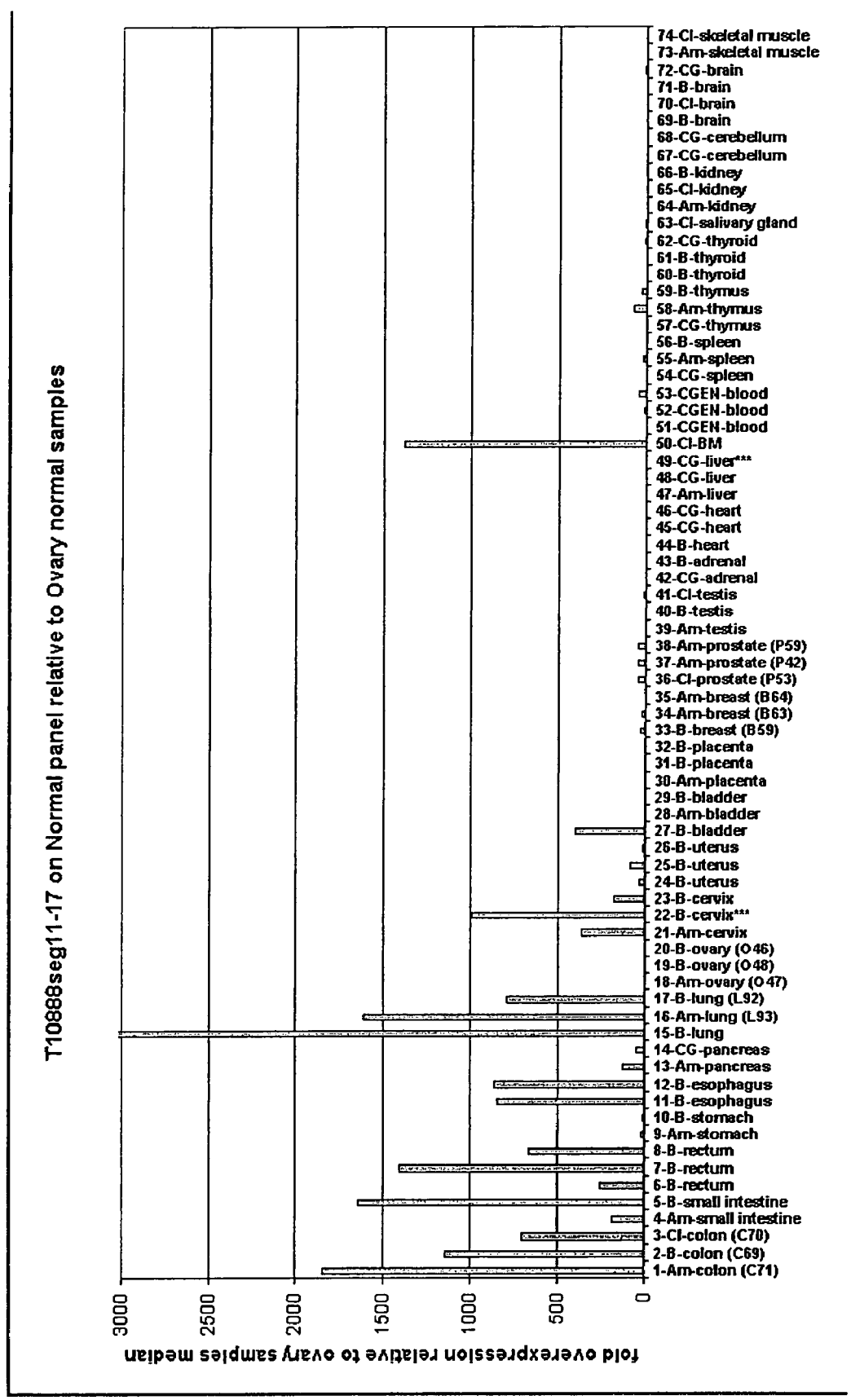
FIG. 11 is a histogram showing expression of T10888junc11-17 (SEQ ID NO:962) transcripts in normal tissues.

The results are described in FIG. 11, presenting the histogram showing the expression of T10888 transcripts which are detectable by amplicon as depicted in sequence name T10888 junc11-17 (SEQ ID NO:962), in different normal tissues. Amplicon and primers are as above.

DESCRIPTION FOR CLUSTER HSECADH

Cluster HSECADH features 4 transcript(s) and 30 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| HSECADH_T11 | 61 |
| HSECADH_T18 | 62 |
| HSECADH_T19 | 63 |
| HSECADH_T20 | 64 |

TABLE 2

Segments of interest

| Segment Name | SEQ ID NO: |
|---|---|
| HSECADH_node_0 | 65 |
| HSECADH_node_14 | 66 |
| HSECADH_node_15 | 67 |
| HSECADH_node_21 | 68 |
| HSECADH_node_22 | 69 |
| HSECADH_node_25 | 70 |
| HSECADH_node_26 | 71 |
| HSECADH_node_48 | 72 |
| HSECADH_node_52 | 73 |
| HSECADH_node_53 | 74 |
| HSECADH_node_54 | 75 |
| HSECADH_node_57 | 76 |
| HSECADH_node_60 | 77 |
| HSECADH_node_62 | 78 |
| HSECADH_node_63 | 79 |
| HSECADH_node_7 | 80 |
| HSECADH_node_1 | 81 |
| HSECADH_node_11 | 82 |
| HSECADH_node_12 | 83 |
| HSECADH_node_17 | 84 |
| HSECADH_node_18 | 85 |
| HSECADH_node_19 | 86 |
| HSECADH_node_3 | 87 |
| HSECADH_node_42 | 88 |
| HSECADH_node_45 | 89 |
| HSECADH_node_46 | 90 |
| HSECADH_node_55 | 91 |
| HSECADH_node_56 | 92 |
| HSECADH_node_58 | 93 |
| HSECADH_node_59 | 94 |

TABLE 3

Proteins of interest

| Protein Name | SEQ ID NO: |
|---|---|
| HSECADH_P9 | 96 |
| HSECADH_P13 | 97 |
| HSECADH_P14 | 98 |
| HSECADH_P15 | 99 |

These sequences are variants of the known protein Epithelial-cadherin precursor (SwissProt accession identifier CAD1_HUMAN; known also according to the synonyms E-cadherin; Uvomorulin; Cadherin-1; CAM 120/80), SEQ ID NO:95, referred to herein as the previously known protein.

The variant proteins according to the present invention are variants of a known diagnostic marker, called E-Cadherin.

Protein Epithelial-cadherin is known or believed to have the following function(s): Cadherins are calcium dependent cell adhesion proteins. They preferentially interact with themselves in a homophilic manner in connecting cells; cadherins may thus contribute to the sorting of heterogeneous cell types. E-cadherin has a potent invasive suppressor role. It is also a ligand for integrin alpha-E/beta-7. The sequence for protein Epithelial-cadherin precursor is given at the end of the application, as "Epithelial-cadherin precursor amino acid sequence". Known polymorphisms for this sequence are as shown in Table 4.

TABLE 4

Amino acid mutations for Known Protein

| SNP position(s) on amino acid sequence | Comment |
|---|---|
| 123 | H – >Y (in diffuse gastric cancer)./FTId = VAR_001306. |
| 193 | T – >P (in diffuse gastric cancer)./FTId = VAR_001307. |
| 418-423 | Missing (in gastric carcinoma)./FTId = VAR_001313. |
| 463 | E – >Q (in diffuse gastric cancer)./FTId = VAR_001314. |
| 470 | T – >I./FTId= VAR_001315. |
| 473 | V – >D (in diffuse gastric cancer)./FTId = VAR_001317. |
| 487 | V – >A (in HDGC)./FTId = VAR_008713. |
| 592 | A – >T (in thyroid cancer; may play a role in colorectal carcinogenesis)./FTId= VAR_001318. |
| 598 | R – >Q (in diffuse gastric cancer)./FTId = VAR_001319. |
| 617 | A – >T (in endometrial cancer; loss of heterozygosity). /FTId = VAR_001320. |
| 711 | L – >V (in endometrial cancer)./FTId = VAR_001321. |
| 838 | S – >G (in ovarian cancer; loss of heterozygosity). /FTId = VAR_001322. |
| 244 | D – >G (in HDGC)./FTId = VAR_008712. |
| 10 | A – >G |
| 16-51 | QVSSWLCQEPEPCHPGFDAESYTFTV-PRRHLERGRV – >RSPLGSQERSPPPCL TRELHVHGAPAPPEKRPR |
| 68-75 | YFSLDTRF – >IFLTPIP |
| 95-102 | QIHFLVYA – >TDPFLGLR |
| 483 | A – >G |
| 530 | A – >R |
| 543 | S – >F |
| 615 | I – >H |
| 634-636 | ASA – >RVP |
| 868 | R – >P |
| 270 | S – >A (may contribute to prostate cancer). /FTId = VAR_013970. |

TABLE 4-continued

Amino acid mutations for Known Protein

| SNP position(s) on amino acid sequence | Comment |
|---|---|
| 882 | D – >H |
| 274-277 | Missing (in gastric adenocarcinoma)./FTId = VAR_001308. |
| 315 | N – >S (in lobular breast carcinoma)./FTId = VAR_001309. |
| 336 | E – >D./FTId = VAR_001310. |
| 340 | T – >A (in HDGC and colorectal cancer). /FTId = VAR_013971. |
| 370 | D – >A (in diffuse gastric cancer)./FTId = VAR_001311. |
| 400 | Missing (in gastric carcinoma; loss of heterozygosity). /FTId = VAR_001312. |

Protein Epithelial-cadherin localization is believed to be Type I membrane protein.

The following GO Annotation(s) apply to the previously known protein. The following annotation(s) were found: cell adhesion; homophilic cell adhesion, which are annotation(s) related to Biological Process; calcium binding; protein binding, which are annotation(s) related to Molecular Function; and membrane; integral membrane protein, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster HSECADH can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 12 refer to weighted expression of ESTs in each category, as "parts per million" (ratio of the expression of ESTs for a particular cluster to the expression of all ESTs in that category, according to parts per million).

Figure 12:
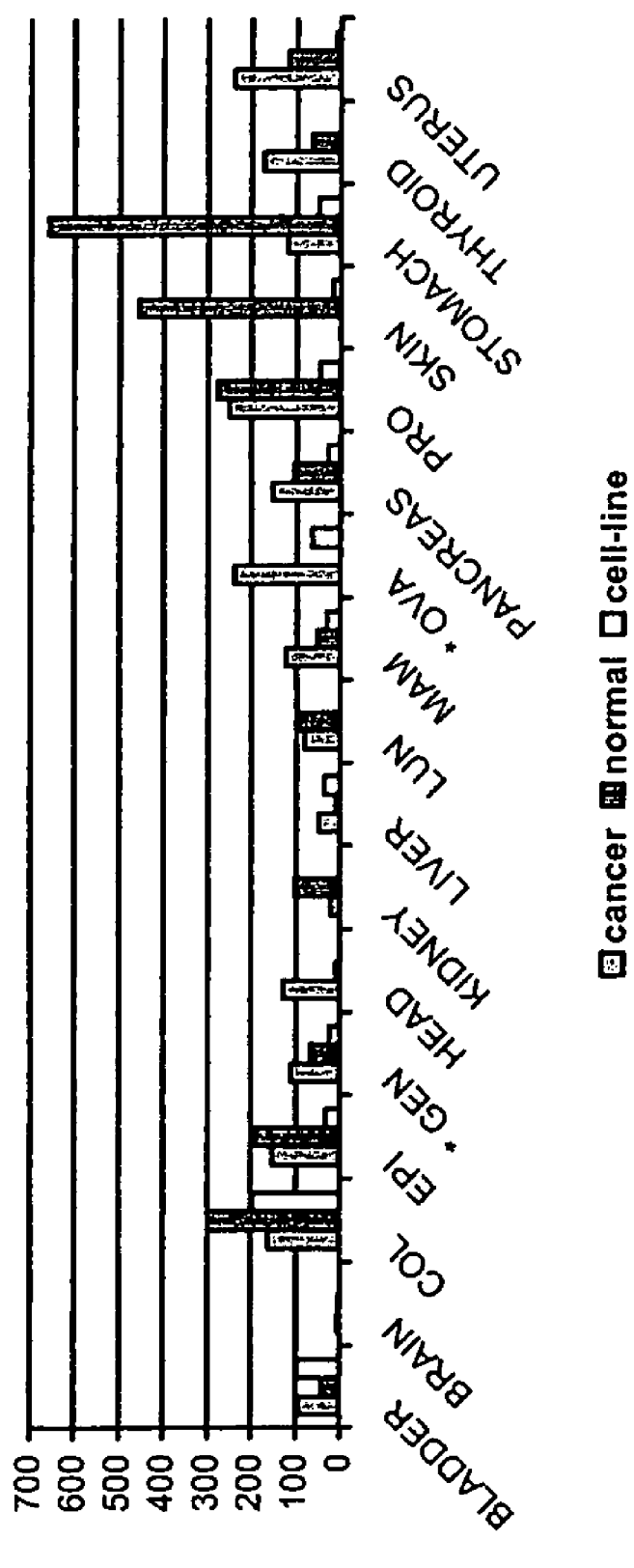
FIG. 12 shows cancer and cell-line vs. normal tissue expression.

Overall, the following results were obtained as shown with regard to the histograms in FIG. 12 and Table 5. This cluster is overexpressed (at least at a minimum level) in the following pathological conditions: a mixture of malignant tumors from different tissues and ovarian carcinoma.

TABLE 5

Normal tissue distribution

| Name of Tissue | Number |
|---|---|
| bladder | 41 |
| brain | 3 |
| colon | 299 |
| epithelial | 190 |
| general | 67 |
| head and neck | 10 |
| kidney | 103 |
| liver | 9 |
| lung | 93 |
| breast | 52 |
| ovary | 0 |
| pancreas | 105 |
| prostate | 279 |
| skin | 457 |
| stomach | 659 |

TABLE 5-continued

Normal tissue distribution

| Name of Tissue | Number |
| --- | --- |
| Thyroid | 64 |
| uterus | 118 |

TABLE 6

P values and ratios for expression in cancerous tissue

| Name of Tissue | P1 | P2 | SP1 | R3 | SP2 | R4 |
| --- | --- | --- | --- | --- | --- | --- |
| bladder | 3.9e−01 | 3.4e−01 | 4.1e−01 | 1.7 | 3.8e−01 | 1.7 |
| brain | 3.7e−01 | 4.9e−01 | 1 | 1.4 | 1 | 1.0 |
| colon | 6.6e−01 | 7.4e−01 | 9.5e−01 | 0.6 | 9.3e−01 | 0.5 |
| epithelial | 1.3e−01 | 6.8e−01 | 9.5e−01 | 0.8 | 1 | 0.5 |
| general | 1.6e−06 | 1.5e−03 | 6.3e−05 | 1.5 | 5.6e−01 | 0.9 |
| head and neck | 1.5e−01 | 2.7e−01 | 4.6e−01 | 2.1 | 7.5e−01 | 1.2 |
| kidney | 8.3e−01 | 8.7e−01 | 9.9e−01 | 0.4 | 1 | 0.3 |
| liver | 4.4e−01 | 6.9e−01 | 1 | 1.7 | 6.9e−01 | 1.5 |
| lung | 7.2e−01 | 8.8e−01 | 7.5e−01 | 0.9 | 9.9e−01 | 0.4 |
| breast | 7.5e−02 | 1.1e−01 | 3.1e−01 | 1.7 | 5.1e−01 | 1.2 |
| ovary | 4.5e−02 | 3.6e−02 | 4.7e−03 | 3.8 | 1.4e−02 | 3.5 |
| pancreas | 5.5e−01 | 6.5e−01 | 2.4e−01 | 0.9 | 5.2e−01 | 0.7 |
| prostate | 8.1e−01 | 8.5e−01 | 6.4e−01 | 0.8 | 9.0e−01 | 0.6 |
| skin | 5.7e−01 | 7.4e−01 | 1 | 0.0 | 1 | 0.1 |
| stomach | 2.2e−01 | 5.2e−01 | 1 | 0.2 | 1 | 0.1 |
| Thyroid | 5.5e−01 | 5.5e−01 | 4.4e−01 | 1.6 | 4.4e−01 | 1.6 |
| uterus | 5.0e−02 | 2.4e−01 | 1.0e−01 | 1.3 | 5.8e−01 | 0.8 |

As noted above, cluster HSECADH features 4 transcript(s), which were listed in Table 1 above. These transcript(s) encode for protein(s) which are variant(s) of protein Epithelial-cadherin precursor. A description of each variant protein according to the present invention is now provided.

Variant protein HSECADH_P9 (SEQ ID NO: 96) according to the present invention has an amino acid sequence as given at the end of the application; it is encoded by transcript(s) HSECADH_T11 (SEQ ID NO: 61). An alignment is given to the known protein (Epithelial-cadherin precursor) at the end of the application. One or more alignments to one or more previously published protein sequences are given at the end of the application. A brief description of the relationship of the variant protein according to the present invention to each such aligned protein is as follows:

Comparison report between HSECADH_P9 (SEQ ID NO: 96) and Q9UII7 (SEQ ID NO: 963) (SEQ ID NO:963):

1. An isolated chimeric polypeptide encoding for HSEC-ADH_P9 (SEQ ID NO: 96), comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDST YRKFSTKVTLNT VGHHHRPPPHQASVSGIQAELLTF-PNSSPGLRRQKRDWVIPPISCPENEKGPFPKNLVQI KSNKDKEGKVFYSITGQGADTP-PVGVFIIERETGWLKVTEPLDRERIATYTLFSHAVSSN GNAVEDPMEILITVTDQNDNKPEFTQEVFKGSVMEG corresponding to amino acids 1-274 of Q9UII7 (SEQ ID NO: 963), which also corresponds to amino acids 1-274 of HSEC-ADH_P9 (SEQ ID NO: 96), and a second amino acid sequence being at least 70%, optionally at least 80%, preferably at least 85%, more preferably at least 90% and most preferably at least 95% homologous to a polypeptide having the sequence TACRSRIANSCHSGDSWRNSCFANSD-SAALAVSSEESGGQRALTAPRG (SEQ ID NO: 1118) corresponding to amino acids 275-322 of HSECADH_P9 (SEQ ID NO: 96), wherein said first and second amino acid sequences are contiguous and in a sequential order.

2. An isolated polypeptide encoding for a tail of HSEC-ADH_P9 (SEQ ID NO: 96), comprising a polypeptide being at least 70%, optionally at least about 80%, preferably at least about 85%, more preferably at least about 90% and most preferably at least about 95% homologous to the sequence TACRSRIANSCHSGDSWRNSCFANSD-SAALAVSSEESGGQRALTAPRG (SEQ ID NO: 1118) in HSECADH_P9 (SEQ ID NO: 96).

Comparison report between HSECADH_P9 (SEQ ID NO: 96) and Q9UII8 (SEQ ID NO: 964) (SEQ ID NO:964):

1. An isolated chimeric polypeptide encoding for HSEC-ADH_P9 (SEQ ID NO: 96), comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDS TYRKFSTKVTLNT VGHHHRPPPHQASVSGIQAELLT-FPNSSPGLRRQKRDWVIPPISCPENEKGPFPKNLVQI KSNKDKEGKVFYSITGQGADTP-PVGVFIIERETGWLKVTEPLDRERIATYTLFSHAVSSN GNAVEDPMEILITVTDQNDNKPEFTQEVFKGSVMEG corresponding to amino acids 1-274 of Q9UII8 (SEQ ID NO: 964), which also corresponds to amino acids 1-274 of HSEC-ADH_P9 (SEQ ID NO: 96), and a second amino acid sequence being at least 70%, optionally at least 80%, preferably at least 85%, more preferably at least 90% and most preferably at least 95% homologous to a polypeptide having the sequence TACRSRIANSCHSGDSWRNSCFANSD-SAALAVSSEESGGQRALTAPRG (SEQ ID NO: 1118) corresponding to amino acids 275-322 of HSECADH_P9 (SEQ ID NO: 96), wherein said first and second amino acid sequences are contiguous and in a sequential order.

2. An isolated polypeptide encoding for a tail of HSEC-ADH_P9 (SEQ ID NO: 96), comprising a polypeptide being at least 70%, optionally at least about 80%, preferably at least about 85%, more preferably at least about 90% and most preferably at least about 95% homologous to the sequence TACRSRIANSCHSGDSWRNSCFANSD-SAALAVSSEESGGQRALTAPRG (SEQ ID NO: 1118) in HSECADH_P9 (SEQ ID NO: 96).

Comparison report between HSECADH_P9 (SEQ ID NO: 96) and CAD1_HUMAN:

1. An isolated chimeric polypeptide encoding for HSEC-ADH_P9 (SEQ ID NO: 96), comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDS TYRKFSTKVTLNT VGHHHRPPPHQASVSGIQAELLT-FPNSSPGLRRQKRDWVIPPISCPENEKGPFPKNLVQI KSNKDKEGKVFYSITGQGADTP-PVGVFIIERETGWLKVTEPLDRERIATYTLFSHAVSSN GNAVEDPMEILITVTDQNDNKPEFTQEVFKGSVMEG corresponding to amino acids 1-274 of CAD1_HUMAN, which also corresponds to amino acids 1-274 of HSEC-ADH_P9 (SEQ ID NO: 96), and a second amino acid sequence being at least 70%, optionally at least 80%, preferably at least 85%, more preferably at least 90% and most preferably at least 95% homologous to a polypeptide having the sequence TACRSRIANSCHSGDSWRNSCFANSD-SAALAVSSEESGGQRALTAPRG (SEQ ID NO: 1118) corresponding to amino acids 275-322 of HSECADH_P9 (SEQ ID NO: 96), wherein said first and second amino acid sequences are contiguous and in a sequential order.

2. An isolated polypeptide encoding for a tail of HSEC-ADH_P9 (SEQ ID NO: 96), comprising a polypeptide being at least 70%, optionally at least about 80%, preferably at least about 85%, more preferably at least about 90% and most preferably at least about 95% homologous to the sequence TACRSRIANSCHSGDSWRNSCFANSD-SAALAVSSEESGGQRALTAPRG (SEQ ID NO: 1118) in HSECADH_P9 (SEQ ID NO: 96).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSECADH_P9 (SEQ ID NO: 96) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein HSECADH_P9 (SEQ ID NO: 96) sequence provides support for the deduced sequence of this variant protein according to the present invention).

TABLE 7

Amino acid mutations

| SNP position(s) on amino acid sequence | Alternative amino acid(s) | Previously known SNP? |
|---|---|---|
| 127 | P - >T | No |
| 141 | T - >A | No |
| 276 | A - >V | No |

Variant protein HSECADH_P9 (SEQ ID NO: 96) is encoded by the following transcript(s): HSECADH_T11 (SEQ ID NO: 61), for which the sequence(s) is/are given at the end of the application. The coding portion of transcript HSECADH_T11 (SEQ ID NO: 61) is shown in bold; this coding portion starts at position 125 and ends at position 1090. The transcript also has the following SNPs as listed in Table 8 (given according to their position on the nucleotide sequence, with the alternative nucleic acid listed; the last column indicates whether the SNP is known or not; the presence of known SNPs in variant protein HSECADH_P9 (SEQ ID NO: 96) sequence provides support for the deduced sequence of this variant protein according to the present invention).

TABLE 8

Nucleic acid SNPs

| SNP position on nucleotide sequence | Alternative nucleic acid | Previously known SNP? |
|---|---|---|
| 71 | G - >C | Yes |
| 469 | G - >A | Yes |
| 1487 | C - >T | Yes |
| 1556 | C - >A | Yes |
| 1556 | C - >G | Yes |
| 1556 | C - >T | Yes |
| 1603 | G - >A | Yes |
| 1604 | G - >A | Yes |
| 1688 | A - >G | Yes |

TABLE 8-continued

Nucleic acid SNPs

| SNP position on nucleotide sequence | Alternative nucleic acid | Previously known SNP? |
|---|---|---|
| 1712 | T - > | No |
| 1890 | T - >G | No |
| 1895 | T - >G | No |
| 503 | C - >A | No |
| 2090 | C - >T | Yes |
| 2621 | T - >A | Yes |
| 2621 | T - >C | Yes |
| 2621 | T - >G | Yes |
| 2797 | - >G | No |
| 2849 | G - >A | No |
| 2992 | A - >C | No |
| 3027 | C - >G | No |
| 3029 | C - >A | No |
| 3134 | T - > | No |
| 545 | A - >G | No |
| 3211 | T - > | No |
| 3258 | A - >G | No |
| 3336 | T - >C | Yes |
| 847 | A - >G | No |
| 951 | C - >T | No |
| 1331 | T - >C | No |
| 1377 | G - >A | No |
| 1487 | C - >A | Yes |
| 1487 | C - >G | Yes |

Variant protein HSECADH_P13 (SEQ ID NO: 97) according to the present invention has an amino acid sequence as given at the end of the application; it is encoded by transcript(s) HSECADH_T18 (SEQ ID NO: 62). An alignment is given to the known protein (Epithelial-cadherin precursor) at the end of the application. One or more alignments to one or more previously published protein sequences are given at the end of the application. A brief description of the relationship of the variant protein according to the present invention to each such aligned protein is as follows:

Comparison report between HSECADH_P13 (SEQ ID NO: 97) and Q9UII7 (SEQ ID NO: 963):

1. An isolated chimeric polypeptide encoding for HSEC-ADH_P13 (SEQ ID NO: 97), comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDST YRKFSTKVTLNT VGHHHRPPPHQASVSGIQAELLTF-PNSSPGLRRQKRDWVIPPISCPENEKGPFPKNLVQI KSNKDKEGKVFYSITGQGADTP-PVGVFIIERETGWLKVTEPLDRERIATYTLFSHAVSSN GNAVEDPMEILITVTDQNDNK-PEFTQEVFKGSVMEGALPGTSVMEVTATDADDDVNT YNAAIAYTILSQDPELPDKNMFTINPNT-GVISVVTTGLDRESFPTYTLVVQAADLQGEGL STTATAVITVTDTNDNPPIFNPTT corresponding to amino acids 1-379 of Q9UII7 (SEQ ID NO: 963), which also corresponds to amino acids 1-379 of HSECADH_P13 (SEQ ID NO: 97), and a second amino acid sequence VIL corresponding to amino acids 380-382 of HSECADH_P13 (SEQ ID NO: 97), wherein said first and second amino acid sequences are contiguous and in a sequential order.

Comparison report between HSECADH_P13 (SEQ ID NO: 97) and Q9UII8 (SEQ ID NO: 964):

1. An isolated chimeric polypeptide encoding for HSEC-ADH_P13 (SEQ ID NO: 97), comprising a first amino acid sequence being at least 90% homologous to MGPWSRSL-SALLLLLQVSSWLCQEPEPCHPGFDAE- SYTFTVPRRHLERGRVLGRVNFED CTGRQRTAYF-
SLDTRFKVGTDGVITVKRPLRFHNPQIHFLVYAWDST
YRKFSTKVTLNT VGHHHRPPPHQASVSGIQAELLTF-
PNSSPGLRRQKRDWVIPPISCPENEKGPFPKNLVQI
KSNKDKEGKVFYSITGQGADTP-
PVGVFIIERETGWLKVTEPLDRERIATYTLFSHAVSSN
GNAVEDPMEILITVTDQNDNK-
PEFTQEVFKGSVMEGALPGTSVMEVTATDADDDVNT
YNAAIAYTILSQDPELPDKNMFTINRN-
TGVISVVTTGLDRESFPTYTLVVQAADLQGEGL
STTATAVITVTDTNDNPPIFNPTT corresponding to amino acids 1-379 of Q9UII8 (SEQ ID NO: 964), which also corresponds to amino acids 1-379 of HSECADH_P13 (SEQ ID NO: 97), and a second amino acid sequence VIL corresponding to amino acids 380-382 of HSECADH_P13 (SEQ ID NO: 97), wherein said first and second amino acid sequences are contiguous and in a sequential order.

Comparison report between HSECADH_P13 (SEQ ID NO: 97) and CAD1_HUMAN:

1. An isolated chimeric polypeptide encoding for HSECADH_P13 (SEQ ID NO: 97), comprising a first amino acid sequence being at least 90% homologous to MGPWSRSL-
SALLLLLQVSSWLCQEPEPCHPGFDAE-
SYTFTVPRRHLERGRVLGRVNFED CTGRQRTAYF-
SLDTRFKVGTDGVITVKRPLRFHNPQIHFLVYAWDST
YRKFSTKVTLNT VGHHHRPPPHQASVSGIQAELLTF-
PNSSPGLRRQKRDWVIPPISCPENEKGPFPKNLVQI
KSNKDKEGKVFYSITGQGADTP-
PVGVFIIERETGWLKVTEPLDRERIATYTLFSHAVSSN
GNAVEDPMEILITVTDQNDNK-
PEFTQEVFKGSVMEGALPGTSVMEVTATDADDDVNT
YNAAIAYTILSQDPELPDKNMFTINRN-
TGVISVVTTGLDRESFPTYTLVVQAADLQGEGL
STTATAVITVTDTNDNPPIFNPTT corresponding to amino acids 1-379 of CAD1_HUMAN, which also corresponds to amino acids 1-379 of HSECADH_P13 (SEQ ID NO: 97), and a second amino acid sequence VIL corresponding to amino acids 380-382 of HSECADH_P13 (SEQ ID NO: 97), wherein said first and second amino acid sequences are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSECADH_P13 (SEQ ID NO: 97) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein HSECADH_P13 (SEQ ID NO: 97) sequence provides support for the deduced sequence of this variant protein according to the present invention).

TABLE 9

Amino acid mutations

| SNP position(s) on amino acid sequence | Alternative amino acid(s) | Previously known SNP? |
|---|---|---|
| 127 | P – >T | No |
| 141 | T – >A | No |

Variant protein HSECADH_P13 (SEQ ID NO: 97) is encoded by the following transcript(s): HSECADH_T18 (SEQ ID NO: 62), for which the sequence(s) is/are given at the end of the application. The coding portion of transcript HSECADH_T18 (SEQ ID NO: 62) is shown in bold; this coding portion starts at position 125 and ends at position 1270. The transcript also has the following SNPs as listed in Table 10 (given according to their position on the nucleotide sequence, with the alternative nucleic acid listed; the last column indicates whether the SNP is known or not; the presence of known SNPs in variant protein HSECADH_P13 (SEQ ID NO: 97) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 71 | G – >C | Yes |
| 469 | G – >A | Yes |
| 503 | C – >A | No |
| 545 | A – >G | No |
| 847 | A – >G | No |
| 1545 | A – >G | Yes |

Variant protein HSECADH_P14 (SEQ ID NO: 98) according to the present invention has an amino acid sequence as given at the end of the application; it is encoded by transcript(s) HSECADH_T19 (SEQ ID NO: 63). An alignment is given to the known protein (Epithelial-cadherin precursor) at the end of the application. One or more alignments to one or more previously published protein sequences are given at the end of the application. A brief description of the relationship of the variant protein according to the present invention to each such aligned protein is as follows:

Comparison report between HSECADH_P14 (SEQ ID NO: 98) and Q9UII7 (SEQ ID NO: 963):

1. An isolated chimeric polypeptide encoding for HSECADH_P14 (SEQ ID NO: 98), comprising a first amino acid sequence being at least 90% homologous to MGPWSRSL-
SALLLLLQVSSWLCQEPEPCHPGFDAE-
SYTFTVPRRHLERGRVLGRVNFED CTGRQRTAYF-
SLDTRFKVGTDGVITVKRPLRFHNPQIHFLVYAWDS
TYRKFSTKVTLNT VGHHHRPPPHQASVSGIQAELLT-
FPNSSPGLRRQKRDWVIPPISCPENEKGPFPKNLVQI
KSNKDKEGKVFYSITGQGADTP-
PVGVFIIERETGWLKVTEPLDRERIATYTLFSHAVSSN
GNAVEDPMEILITVTDQNDNK-
PEFTQEVFKGSVMEGALPGTSVMEVTATDADDDVNT
YNAAIAYTILSQDPELPDKNMFTINRN-
TGVISVVTTGLDRE corresponding to amino acids 1-336 of Q9UII7 (SEQ ID NO: 963), which also corresponds to amino acids 1-336 of HSECADH_P14 (SEQ ID NO: 98), and a second amino acid sequence being at least 70%, optionally at least 80%, preferably at least 85%, more preferably at 90% and most preferably at least 95% homologous to a polypeptide having the sequence VRGQEDPEGVEDKCV-LAQSRGQSKILLGQLSVNTVMV (SEQ ID NO: 1119) corresponding to amino acids 337-373 of HSECADH_P14 (SEQ ID NO: 98), wherein said first and second amino acid sequences are contiguous and in a sequential order.

2. An isolated polypeptide encoding for a tail of HSECADH_P14 (SEQ ID NO: 98), comprising a polypeptide being at least 70%, optionally at least about 80%, preferably at least about 85%, more preferably at least about 90% and most preferably at least about 95% homologous to the sequence VRGQEDPEGVEDKCVLAQS-RGQSKILLGQLSVNTVMV (SEQ ID NO: 1119) in HSECADH_P14 (SEQ ID NO: 98).

Comparison report between HSECADH_P14 (SEQ ID NO: 98) and Q9UII8 (SEQ ID NO: 964):

1. An isolated chimeric polypeptide encoding for HSECADH_P14 (SEQ ID NO: 98), comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDST YRKFSTKVTLNT VGHHHRPPPHQASVSGIQAELLTF-PNSSPGLRRQKRDWVIPPISCPENEKGPFPKNLVQI KSNKDKEGKVFYSITGQGADTP-PVGVFIIERETGWLKVTEPLDRERIATYTLFSHAVSSN GNAVEDPMEILITVTDQNDNK-PEFTQEVFKGSVMEGALPGTSVMEVTATDADDDVNT YNAAIAYTILSQDPELPDKNMFTINRN-TGVISVVTTGLDRE corresponding to amino acids 1-336 of Q9UII8 (SEQ ID NO: 964), which also corresponds to amino acids 1-336 of HSECADH_P14 (SEQ ID NO: 98), and a second amino acid sequence being at least 70%, optionally at least 80%, preferably at least 85%, more preferably at least 90% and most preferably at least 95% homologous to a polypeptide having the sequence VRGQEDPEGVEDKCV-LAQSRGQSKILLGQLSVNTVMV (SEQ ID NO: 1119) corresponding to amino acids 337-373 of HSECADH_P14 (SEQ ID NO: 98), wherein said first and second amino acid sequences are contiguous and in a sequential order.

2. An isolated polypeptide encoding for a tail of HSECADH_P14 (SEQ ID NO: 98), comprising a polypeptide being at least 70%, optionally at least about 80%, preferably at least about 85%, more preferably at least about 90% and most preferably at least about 95% homologous to the sequence VRGQEDPEGVEDKCVLAQS-RGQSKILLGQLSVNTVMV (SEQ ID NO: 1119) in HSECADH_P14 (SEQ ID NO: 98).

Comparison report between HSECADH_P14 (SEQ ID NO: 98) and CAD1_HUMAN:

1. An isolated chimeric polypeptide encoding for HSECADH_P14 (SEQ ID NO: 98), comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDST YRKFSTKVTLNT VGHHHRPPPHQASVSGIQAELLTF-PNSSPGLRRQKRDWVIPPISCPENEKGPFPKNLVQI KSNKDKEGKVFYSITGQGADTP-PVGVFIIERETGWLKVTEPLDRERIATYTLFSHAVSSN GNAVEDPMEILITVTDQNDNK-PEFTQEVFKGSVMEGALPGTSVMEVTATDADDDVNT YNAAIAYTILSQDPELPDKNMFTINRN-TGVISVVTTGLDRE corresponding to amino acids 1-336 of CAD1_HUMAN, which also corresponds to amino acids 1-336 of HSECADH_P14 (SEQ ID NO: 98), and a second amino acid sequence being at least 70%, optionally at least 80%, preferably at least 85%, more preferably at least 90% and most preferably at least 95% homologous to a polypeptide having the sequence VRGQEDPEGVEDKCVLAQS-RGQSKILLGQLSVNTVMV (SEQ ID NO: 1119) corresponding to amino acids 337-373 of HSECADH_P14 (SEQ ID NO: 98), wherein said first and second amino acid sequences are contiguous and in a sequential order.

2. An isolated polypeptide encoding for a tail of HSECADH_P14 (SEQ ID NO: 98), comprising a polypeptide being at least 70%, optionally at least about 80%, preferably at least about 85%, more preferably at least about 90% and most preferably at least about 95% homologous to the sequence VRGQEDPEGVEDKCVLAQS-RGQSKILLGQLSVNTVMV (SEQ ID NO: 1119) in HSECADH_P14 (SEQ ID NO: 98).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSECADH_P14 (SEQ ID NO: 98) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein HSECADH_P14 (SEQ ID NO: 98) sequence provides support for the deduced sequence of this variant protein according to the present invention).

TABLE 11

| SNP position(s) on amino acid sequence | Amino acid mutations Alternative amino acid(s) | Previously known SNP? |
|---|---|---|
| 127 | P − >T | No |
| 141 | T − >A | No |

Variant protein HSECADH_P14 (SEQ ID NO: 98) is encoded by the following transcript(s): HSECADH_T19 (SEQ ID NO: 63), for which the sequence(s) is/are given at the end of the application. The coding portion of transcript HSECADH_T19 (SEQ ID NO: 63) is shown in bold; this coding portion starts at position 125 and ends at position 1243. The transcript also has the following SNPs as listed in Table 12 (given according to their position on the nucleotide sequence, with the alternative nucleic acid listed; the last column indicates whether the SNP is known or not; the presence of known SNPs in variant protein HSECADH_P14 (SEQ ID NO: 98) sequence provides support for the deduced sequence of this variant protein according to the present invention).

TABLE 12

Nucleic acid SNPs

| SNP position on nucleotide sequence | Alternative nucleic acid | Previously known SNP? |
|---|---|---|
| 71 | G - >C | Yes |
| 469 | G - >A | Yes |
| 503 | C - >A | No |
| 545 | A - >G | No |
| 847 | A - >G | No |

Variant protein HSECADH_P15 (SEQ ID NO: 99) according to the present invention has an amino acid sequence as given at the end of the application; it is encoded by transcript(s) HSECADH_T20 (SEQ ID NO: 64). An alignment is given to the known protein (Epithelial-cadherin precursor) at the end of the application. One or more alignments to one or more previously published protein sequences are given at the end of the application. A brief description of the relationship of the variant protein according to the present invention to each such aligned protein is as follows:

Comparison report between HSECADH_P15 (SEQ ID NO: 99) and Q9UII7 (SEQ ID NO: 963):

1. An isolated chimeric polypeptide encoding for HSECADH_P15 (SEQ ID NO: 99), comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDST YRKFSTKVTLNT VGHHHRPPPHQASVSGIQAELLTF-PNSSPGLRRQKRDWVIPPISCPENEKGPFPKNLVQI KSNKDKEGKVFYSITGQGADTP-PVGVFIIERETGWLKVTEPLDRERIATYT corresponding to amino acids 1-229 of Q9UII7 (SEQ ID NO: 963), which also corresponds to amino acids 1-229 of HSECADH_P15 (SEQ ID NO: 99), and a second amino acid sequence VSIS corresponding to amino acids 230-233 of HSECADH_P15 (SEQ ID NO: 99), wherein said first and second amino acid sequences are contiguous and in a sequential order.

Comparison report between HSECADH_P15 (SEQ ID NO: 99) and Q9UII8 (SEQ ID NO: 964):

1. An isolated chimeric polypeptide encoding for HSECADH_P15 (SEQ ID NO: 99), comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDST YRKFSTKVTLNT VGHHHRPPPHQASVSGIQAELLTF-PNSSPGLRRQKRDWVIPPISCPENEKGPFPKNLVQI KSNKDKEGKVFYSITGQGADTP-PVGVFIIERETGWLKVTEPLDRERIATYT corresponding to amino acids 1-229 of Q9UII8 (SEQ ID NO: 964), which also corresponds to amino acids 1-229 of HSECADH_P15 (SEQ ID NO: 99), and a second amino acid sequence VSIS corresponding to amino acids 230-233 of HSECADH_P15 (SEQ ID NO: 99), wherein said first and second amino acid sequences are contiguous and in a sequential order.

Comparison report between HSECADH_P15 (SEQ ID NO: 99) and CAD1_HUMAN:

1. An isolated chimeric polypeptide encoding for HSECADH_P15 (SEQ ID NO: 99), comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDS TYRKFSTKVTLNT VGHHHRPPPHQASVSGIQAELLT-FPNSSPGLRRQKRDWVIPPISCPENEKGPFPKNLVQI KSNKDKEGKVFYSITGQGADTP-PVGVFIIERETGWLKVTEPLDRERIATYT corresponding to amino acids 1-229 of CAD1_HUMAN, which also corresponds to amino acids 1-229 of HSECADH_P15 (SEQ ID NO: 99), and a second amino acid sequence VSIS corresponding to amino acids 230-233 of HSECADH_P15 (SEQ ID NO: 99), wherein said first and second amino acid sequences are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSECADH_P15 (SEQ ID NO: 99) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein HSECADH_P15 (SEQ ID NO: 99) sequence provides support for the deduced sequence of this variant protein according to the present invention).

TABLE 13

Amino acid mutations

| SNP position(s) on amino acid sequence | Alternative amino acid(s) | Previously known SNP? |
|---|---|---|
| 127 | P - >T | No |
| 141 | T - >A | No |

Variant protein HSECADH_P15 (SEQ ID NO: 99) is encoded by the following transcript(s): HSECADH_T20 (SEQ ID NO: 64), for which the sequence(s) is/are given at the end of the application. The coding portion of transcript HSECADH_T20 (SEQ ID NO: 64) is shown in bold; this coding portion starts at position 125 and ends at position 823. The transcript also has the following SNPs as listed in Table 14 (given according to their position on the nucleotide sequence, with the alternative nucleic acid listed; the last column indicates whether the SNP is known or not; the presence of known SNPs in variant protein HSECADH_P15 (SEQ ID NO: 99) sequence provides support for the deduced sequence of this variant protein according to the present invention).

TABLE 14

Nucleic acid SNPs

| SNP position on nucleotide sequence | Alternative nucleic acid | Previously known SNP? |
|---|---|---|
| 71 | G - >C | Yes |
| 469 | G - >A | Yes |
| 503 | C - >A | No |
| 545 | A - >G | No |
| 955 | G - >A | Yes |

As noted above, cluster HSECADH features 30 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSECADH_node_0 (SEQ ID NO: 65) according to the present invention is supported by 17 libraries. The number of libraries was determined as previously described. This segment can be found in the following transcript(s): HSECADH_T11 (SEQ ID NO: 61), HSECADH_T18 (SEQ ID NO: 62), HSECADH_T19 (SEQ ID NO: 63) and HSECADH_T20 (SEQ ID NO: 64). Table 15 below describes the starting and ending position of this segment on each transcript.

TABLE 15

Segment location on transcripts

| Transcript name | Segment starting position | Segment ending position |
|---|---|---|
| HSECADH_T11 (SEQ ID NO:61) | 1 | 166 |
| HSECADH_T18 (SEQ ID NO:62) | 1 | 166 |
| HSECADH_T19 (SEQ ID NO:63) | 1 | 166 |
| HSECADH_T20 (SEQ ID NO:64) | 1 | 166 |

Segment cluster HSECADH_node_14 (SEQ ID NO: 66) according to the present invention is supported by 40 libraries. The number of libraries was determined as previously described. This segment can be found in the following transcript(s): HSECADH_T11 (SEQ ID NO: 61), HSECADH_T18 (SEQ ID NO: 62), HSECADH_T19 (SEQ ID NO: 63) and HSECADH_T20 (SEQ ID NO: 64). Table 16 below describes the starting and ending position of this segment on each transcript.

TABLE 16

Segment location on transcripts

| Transcript name | Segment starting position | Segment ending position |
|---|---|---|
| HSECADH_T11 (SEQ ID NO:61) | 656 | 811 |
| HSECADH_T18 (SEQ ID NO:62) | 656 | 811 |
| HSECADH_T19 (SEQ ID NO:63) | 656 | 811 |
| HSECADH_T20 (SEQ ID NO:64) | 656 | 811 |

Segment cluster HSECADH_node_15 (SEQ ID NO: 67) according to the present invention is supported by 1 libraries. The number of libraries was determined as previously described. This segment can be found in the following transcript(s): HSECADH_T20 (SEQ ID NO: 64). Table 17 below describes the starting and ending position of this segment on each transcript.

TABLE 17

Segment location on transcripts

| Transcript name | Segment starting position | Segment ending position |
|---|---|---|
| HSECADH_T20 (SEQ ID NO:64) | 812 | 970 |

Segment cluster HSECADH_node_21 (SEQ ID NO: 68) according to the present invention is supported by 40 libraries. The number of libraries was determined as previously described. This segment can be found in the following transcript(s): HSECADH_T18 (SEQ ID NO: 62) and HSECADH_T19 (SEQ ID NO: 63). Table 18 below describes the starting and ending position of this segment on each transcript.

TABLE 18

Segment location on transcripts

| Transcript name | Segment starting position | Segment ending position |
|---|---|---|
| HSECADH_T18 (SEQ ID NO:62) | 957 | 1132 |
| HSECADH_T19 (SEQ ID NO:63) | 957 | 1132 |

Segment cluster HSECADH_node_22 (SEQ ID NO: 69) according to the present invention is supported by 1 libraries. The number of libraries was determined as previously described. This segment can be found in the following transcript(s): HSECADH_T19 (SEQ ID NO: 63). Table 19 below describes the starting and ending position of this segment on each transcript.

TABLE 19

Segment location on transcripts

| Transcript name | Segment starting position | Segment ending position |
|---|---|---|
| HSECADH_T19 (SEQ ID NO:63) | 1133 | 1269 |

Segment cluster HSECADH_node_25 (SEQ ID NO: 70) according to the present invention is supported by 34 libraries. The number of libraries was determined as previously described. This segment can be found in the following transcript(s): HSECADH_T18 (SEQ ID NO: 62). Table 20 below describes the starting and ending position of this segment on each transcript.

TABLE 20

Segment location on transcripts

| Transcript name | Segment starting position | Segment ending position |
|---|---|---|
| HSECADH_T18 (SEQ ID NO:62) | 1133 | 1261 |

Segment cluster HSECADH_node_26 (SEQ ID NO: 71) according to the present invention is supported by 1 libraries. The number of libraries was determined as previously described. This segment can be found in the following transcript(s): HSECADH_T18 (SEQ ID NO: 62). Table 21 below describes the starting and ending position of this segment on each transcript.

TABLE 21

Segment location on transcripts

| Transcript name | Segment starting position | Segment ending position |
|---|---|---|
| HSECADH_T18 (SEQ ID NO:62) | 1262 | 1584 |

Segment cluster HSECADH_node__48 (SEQ ID NO: 72) according to the present invention is supported by 44 libraries. The number of libraries was determined as previously described. This segment can be found in the following transcript(s): HSECADH_T11 (SEQ ID NO: 61). Table 22 below describes the starting and ending position of this segment on each transcript.

TABLE 22

Segment location on transcripts

| Transcript name | Segment starting position | Segment ending position |
|---|---|---|
| HSECADH_T11 (SEQ ID NO:61) | 1149 | 1292 |

Segment cluster HSECADH_node__52 (SEQ ID NO: 73) according to the present invention is supported by 39 libraries. The number of libraries was determined as previously described. This segment can be found in the following transcript(s): HSECADH_T11 (SEQ ID NO: 61). Table 23 below describes the starting and ending position of this segment on each transcript.

TABLE 23

Segment location on transcripts

| Transcript name | Segment starting position | Segment ending position |
|---|---|---|
| HSECADH_T11 (SEQ ID NO:61) | 1293 | 1449 |

Segment cluster HSECADH_node__53 (SEQ ID NO: 74) according to the present invention is supported by 59 libraries. The number of libraries was determined as previously described. This segment can be found in the following transcript(s): HSECADH_T11 (SEQ ID NO: 61). Table 24 below describes the starting and ending position of this segment on each transcript.

TABLE 24

Segment location on transcripts

| Transcript name | Segment starting position | Segment ending position |
|---|---|---|
| HSECADH_T11 (SEQ ID NO:61) | 1450 | 1933 |

Segment cluster HSECADH_node__54 (SEQ ID NO: 75) according to the present invention is supported by 44 libraries. The number of libraries was determined as previously described. This segment can be found in the following transcript(s): HSECADH_T11 (SEQ ID NO: 61). Table 25 below describes the starting and ending position of this segment on each transcript.

TABLE 25

Segment location on transcripts

| Transcript name | Segment starting position | Segment ending position |
|---|---|---|
| HSECADH_T11 (SEQ ID NO:61) | 1934 | 2053 |

Segment cluster HSECADH_node__57 (SEQ ID NO: 76) according to the present invention is supported by 67 libraries. The number of libraries was determined as previously described. This segment can be found in the following transcript(s): HSECADH_T11 (SEQ ID NO: 61). Table 26 below describes the starting and ending position of this segment on each transcript.

TABLE 26

Segment location on transcripts

| Transcript name | Segment starting position | Segment ending position |
|---|---|---|
| HSECADH_T11 (SEQ ID NO:61) | 2241 | 2430 |

Segment cluster HSECADH_node__60 (SEQ ID NO: 77) according to the present invention is supported by 260 libraries. The number of libraries was determined as previously described. This segment can be found in the following transcript(s): HSECADH_T11 (SEQ ID NO: 61). Table 27 below describes the starting and ending position of this segment on each transcript.

TABLE 27

Segment location on transcripts

| Transcript name | Segment starting position | Segment ending position |
|---|---|---|
| HSECADH_T11 (SEQ ID NO:61) | 2504 | 3096 |

Segment cluster HSECADH_node__62 (SEQ ID NO: 78) according to the present invention is supported by 173 libraries. The number of libraries was determined as previously described. This segment can be found in the following transcript(s): HSECADH_T11 (SEQ ID NO: 61). Table 28 below describes the starting and ending position of this segment on each transcript.

TABLE 28

Segment location on transcripts

| Transcript name | Segment starting position | Segment ending position |
|---|---|---|
| HSECADH_T11 (SEQ ID NO:61) | 3097 | 3245 |

Segment cluster HSECADH_node__63 (SEQ ID NO: 79) according to the present invention is supported by 162 libraries. The number of libraries was determined as previously described. This segment can be found in the following transcript(s): HSECADH_T11 (SEQ ID NO: 61). Table 29 below describes the starting and ending position of this segment on each transcript.

TABLE 29

Segment location on transcripts

| Transcript name | Segment starting position | Segment ending position |
|---|---|---|
| HSECADH_T11 (SEQ ID NO:61) | 3246 | 3544 |

Segment cluster HSECADH_node__7 (SEQ ID NO: 80) according to the present invention is supported by 21 libraries. The number of libraries was determined as previously described.

This segment can be found in the following transcript(s): HSECADH_T11 (SEQ ID NO: 61), HSECADH_T18 (SEQ ID NO: 62), HSECADH_T19 (SEQ ID NO: 63) and HSECADH_T20 (SEQ ID NO: 64). Table 30 below describes the starting and ending position of this segment on each transcript.

TABLE 30

Segment location on transcripts

| Transcript name | Segment starting position | Segment ending position |
|---|---|---|
| HSECADH_T11 (SEQ ID NO:61) | 288 | 511 |
| HSECADH_T18 (SEQ ID NO:62) | 288 | 511 |
| HSECADH_T19 (SEQ ID NO:63) | 288 | 511 |
| HSECADH_T20 (SEQ ID NO:64) | 288 | 511 |

According to an optional embodiment of the present invention, short segments related to the above cluster are also provided. These segments are up to about 120 bp in length, and so are included in a separate description.

Segment cluster HSECADH_node__1 (SEQ ID NO: 81) according to the present invention can be found in the following transcript(s): HSECADH_T11 (SEQ ID NO: 61), HSECADH_T18 (SEQ ID NO: 62), HSECADH_T19 (SEQ ID NO: 63) and HSECADH_T20 (SEQ ID NO: 64). Table 31 below describes the starting and ending position of this segment on each transcript.

TABLE 31

Segment location on transcripts

| Transcript name | Segment starting position | Segment ending position |
|---|---|---|
| HSECADH_T11 (SEQ ID NO:61) | 167 | 172 |
| HSECADH_T18 (SEQ ID NO:62) | 167 | 172 |
| HSECADH_T19 (SEQ ID NO:63) | 167 | 172 |
| HSECADH_T20 (SEQ ID NO:64) | 167 | 172 |

Segment cluster HSECADH_node__11 (SEQ ID NO: 82) according to the present invention is supported by 23 libraries. The number of libraries was determined as previously described. This segment can be found in the following transcript(s): HSECADH_T11 (SEQ ID NO: 61), HSECADH_T18 (SEQ ID NO: 62), HSECADH_T19 (SEQ ID NO: 63) and HSECADH_T20 (SEQ ID NO: 64). Table 32 below describes the starting and ending position of this segment on each transcript.

TABLE 32

Segment location on transcripts

| Transcript name | Segment starting position | Segment ending position |
|---|---|---|
| HSECADH_T11 (SEQ ID NO:61) | 512 | 592 |
| HSECADH_T18 (SEQ ID NO:62) | 512 | 592 |
| HSECADH_T19 (SEQ ID NO:63) | 512 | 592 |
| HSECADH_T20 (SEQ ID NO:64) | 512 | 592 |

Segment cluster HSECADH_node__12 (SEQ ID NO: 83) according to the present invention is supported by 26 libraries. The number of libraries was determined as previously described. This segment can be found in the following transcript(s): HSECADH_T11 (SEQ ID NO: 61), HSECADH_T18 (SEQ ID NO: 62), HSECADH_T19 (SEQ ID NO: 63) and HSECADH_T20 (SEQ ID NO: 64). Table 33 below describes the starting and ending position of this segment on each transcript.

TABLE 33

Segment location on transcripts

| Transcript name | Segment starting position | Segment ending position |
|---|---|---|
| HSECADH_T11 (SEQ ID NO:61) | 593 | 655 |
| HSECADH_T18 (SEQ ID NO:62) | 593 | 655 |
| HSECADH_T19 (SEQ ID NO:63) | 593 | 655 |
| HSECADH_T20 (SEQ ID NO:64) | 593 | 655 |

Segment cluster HSECADH_node__17 (SEQ ID NO: 84) according to the present invention can be found in the following transcript(s): HSECADH_T11 (SEQ ID NO: 61), HSEC-ADH_T18 (SEQ ID NO: 62) and HSECADH_T19 (SEQ ID NO: 63). Table 34 below describes the starting and ending position of this segment on each transcript.

TABLE 34

Segment location on transcripts

| Transcript name | Segment starting position | Segment ending position |
|---|---|---|
| HSECADH_T11 (SEQ ID NO:61) | 812 | 827 |
| HSECADH_T18 (SEQ ID NO:62) | 812 | 827 |
| HSECADH_T19 (SEQ ID NO:63) | 812 | 827 |

Segment cluster HSECADH_node__18 (SEQ ID NO: 85) according to the present invention is supported by 41 libraries. The number of libraries was determined as previously described. This segment can be found in the following transcript(s): HSECADH_T11 (SEQ ID NO: 61), HSEC-ADH_T18 (SEQ ID NO: 62) and HSECADH_T19 (SEQ ID NO: 63). Table 35 below describes the starting and ending position of this segment on each transcript.

TABLE 35

Segment location on transcripts

| Transcript name | Segment starting position | Segment ending position |
|---|---|---|
| HSECADH_T11 (SEQ ID NO:61) | 828 | 944 |
| HSECADH_T18 (SEQ ID NO:62) | 828 | 944 |
| HSECADH_T19 (SEQ ID NO:63) | 828 | 944 |

Segment cluster HSECADH_node__19 (SEQ ID NO: 86) according to the present invention can be found in the following transcript(s): HSECADH_T18 (SEQ ID NO: 62) and HSECADH_T19 (SEQ ID NO: 63). Table 36 below describes the starting and ending position of this segment on each transcript.

TABLE 36

Segment location on transcripts

| Transcript name | Segment starting position | Segment ending position |
|---|---|---|
| HSECADH_T18 (SEQ ID NO:62) | 945 | 956 |
| HSECADH_T19 (SEQ ID NO:63) | 945 | 956 |

Segment cluster HSECADH_node__3 (SEQ ID NO: 87) according to the present invention is supported by 18 libraries. The number of libraries was determined as previously described. This segment can be found in the following transcript(s): HSECADH_T11 (SEQ ID NO: 61), HSEC-ADH_T18 (SEQ ID NO: 62), HSECADH_T19 (SEQ ID NO: 63) and HSECADH_T20 (SEQ ID NO: 64). Table 37 below describes the starting and ending position of this segment on each transcript.

TABLE 37

Segment location on transcripts

| Transcript name | Segment starting position | Segment ending position |
|---|---|---|
| HSECADH_T11 (SEQ ID NO:61) | 173 | 287 |
| HSECADH_T18 (SEQ ID NO:62) | 173 | 287 |
| HSECADH_T19 (SEQ ID NO:63) | 173 | 287 |
| HSECADH_T20 (SEQ ID NO:64) | 173 | 287 |

Segment cluster HSECADH_node__42 (SEQ ID NO: 88) according to the present invention is supported by 43 libraries. The number of libraries was determined as previously described. This segment can be found in the following transcript(s): HSECADH_T11 (SEQ ID NO: 61). Table 38 below describes the starting and ending position of this segment on each transcript.

TABLE 38

Segment location on transcripts

| Transcript name | Segment starting position | Segment ending position |
|---|---|---|
| HSECADH_T11 (SEQ ID NO:61) | 945 | 1017 |

Segment cluster HSECADH_node__45 (SEQ ID NO: 89) according to the present invention is supported by 39 libraries. The number of libraries was determined as previously described. This segment can be found in the following transcript(s): HSECADH_T11 (SEQ ID NO: 61). Table 39 below describes the starting and ending position of this segment on each transcript.

TABLE 39

Segment location on transcripts

| Transcript name | Segment starting position | Segment ending position |
|---|---|---|
| HSECADH_T11 (SEQ ID NO:61) | 1018 | 1051 |

Segment cluster HSECADH_node__46 (SEQ ID NO: 90) according to the present invention is supported by 40 libraries. The number of libraries was determined as previously described. This segment can be found in the following transcript(s): HSECADH_T11 (SEQ ID NO: 61). Table 40 below describes the starting and ending position of this segment on each transcript.

TABLE 40

Segment location on transcripts

| Transcript name | Segment starting position | Segment ending position |
|---|---|---|
| HSECADH_T11 (SEQ ID NO:61) | 1052 | 1148 |

Segment cluster HSECADH_node__55 (SEQ ID NO: 91) according to the present invention is supported by 36 libraries. The number of libraries was determined as previously described. This segment can be found in the following transcript(s): HSECADH_T11 (SEQ ID NO: 61). Table 41 below describes the starting and ending position of this segment on each transcript.

TABLE 41

Segment location on transcripts

| Transcript name | Segment starting position | Segment ending position |
|---|---|---|
| HSECADH_T11 (SEQ ID NO:61) | 2054 | 2166 |

Segment cluster HSECADH_node__56 (SEQ ID NO: 92) according to the present invention is supported by 42 libraries. The number of libraries was determined as previously described. This segment can be found in the following transcript(s): HSECADH_T11 (SEQ ID NO: 61). Table 42 below describes the starting and ending position of this segment on each transcript.

TABLE 42

Segment location on transcripts

| Transcript name | Segment starting position | Segment ending position |
|---|---|---|
| HSECADH_T11 (SEQ ID NO:61) | 2167 | 2240 |

Segment cluster HSECADH_node__58 (SEQ ID NO: 93) according to the present invention is supported by 61 libraries. The number of libraries was determined as previously described. This segment can be found in the following transcript(s): HSECADH_T11 (SEQ ID NO: 61). Table 43 below describes the starting and ending position of this segment on each transcript.

TABLE 43

Segment location on transcripts

| Transcript name | Segment starting position | Segment ending position |
|---|---|---|
| HSECADH_T11 (SEQ ID NO:61) | 2431 | 2481 |

Segment cluster HSECADH_node__59 (SEQ ID NO: 94) according to the present invention can be found in the following transcript(s): HSECADH_T11 (SEQ ID NO: 61). Table 44 below describes the starting and ending position of this segment on each transcript.

TABLE 44

Segment location on transcripts

| Transcript name | Segment starting position | Segment ending position |
|---|---|---|
| HSECADH_T11 (SEQ ID NO:61) | 2482 | 2503 |

Variant protein alignment to the previously known protein:

Sequence name: /tmp/2x0I2XZlA3/JXvUszCm3O:Q9UII7 (SEQ ID NO: 963)

Sequence documentation:

Alignment of: HSECADH_P9 (SEQ ID NO: 96) x Q9UII7 (SEQ ID NO: 963) . . .

Alignment segment 1/1:

Quality: 2727.00

Escore: 0

Matching length: 274 Total length: 274

Matching Percent Similarity: 100.00 Matching Percent Identity: 100.00

Total Percent Similarity: 100.00 Total Percent Identity: 100.00

Gaps: 0

Alignment:

```
  1 MGPWSRSLSALLLLLQVSSWLCQEPEPCHPGFDAESYTFTVPRRHLERGR   50
    ||||||||||||||||||||||||||||||||||||||||||||||||||
  1 MGPWSRSLSALLLLLQVSSWLCQEPEPCHPGFDAESYTFTVPRRHLERGR   50

51 VLGRVNFEDCTGRQRTAYFSLDTRFKVGTDGVITVKRPLRFHNPQIHFLV  100
    ||||||||||||||||||||||||||||||||||||||||||||||||||
 51 VLGRVNFEDCTGRQRTAYFSLDTRFKVGTDGVITVKRPLRFHNPQIHFLV  100

101 YAWDSTYRKFSTKVTLNTVGHHHRPPPHQASVSGIQAELLTFPNSSPGLR  150
    ||||||||||||||||||||||||||||||||||||||||||||||||||
101 YAWDSTYRKFSTKVTLNTVGHHHRPPPHQASVSGIQAELLTFPNSSPGLR  150
```

-continued

```
151  RQKRDWVIPPISCPENEKGPFPKNLVQIKSNKDKEGKVFYSITGQGADTP  200
     ||||||||||||||||||||||||||||||||||||||||||||||||||
151  RQKRDWVIPPISCPENEKGPFPKNLVQIKSNKDKEGKVFYSITGQGADTP  200

201  PVGVFIIERETGWLKVTEPLDRERIATYTLFSHAVSSNGNAVEDPMEILI  250
     ||||||||||||||||||||||||||||||||||||||||||||||||||
201  PVGVFIIERETGWLKVTEPLDRERIATYTLFSHAVSSNGNAVEDPMEILI  250

251  TVTDQNDNKPEFTQEVFKGSVMEG                           274
     ||||||||||||||||||||||||
251  TVTDQNDNKPEFTQEVFKGSVMEG                           274
```

Sequence name: /tmp/2x0I2XZlA3/JXvUszCm3O:Q9UII8 (SEQ ID NO: 964)

Sequence documentation:

Alignment of: HSECADH_P9 (SEQ ID NO: 96) x Q9UII8 (SEQ ID NO: 964) . . .

Alignment segment 1/1:
  Quality: 2727.00

Escore: 0
  Matching length: 274 Total length: 274

Matching Percent Similarity: 100.00 Matching Percent Identity: 100.00
  Total Percent Similarity: 100.00 Total Percent Identity: 100.00
  Gaps: 0

Alignment:

Sequence documentation:

Alignment of: HSECADH_P9 (SEQ ID NO: 96) x CAD1_HUMAN . . .

Alignment segment 1/1:
  Quality: 2727.00

Escore: 0
  Matching length: 274 Total length: 274

Matching Percent Similarity: 100.00 Matching Percent Identity: 100.00
  Total Percent Similarity: 100.00 Total Percent Identity: 100.00
  Gaps: 0

Alignment:

```
1    MGPWSRSLSALLLLLQVSSWLCQEPEPCHPGFDAESYTFTVPRRHLERGR  50
     ||||||||||||||||||||||||||||||||||||||||||||||||||
1    MGPWSRSLSALLLLLQVSSWLCQEPEPCHPGFDAESYTFTVPRRHLERGR  50

51   VLGRVNFEDCTGRQRTAYFSLDTRFKVGTDGVITVKRPLRFHNPQIHFLV  100
     ||||||||||||||||||||||||||||||||||||||||||||||||||
51   VLGRVNFEDCTGRQRTAYFSLDTRFKVGTDGVITVKRPLRFHNPQIHFLV  100

101  YAWDSTYRKFSTKVTLNTVGHHHRPPPHQASVSGIQAELLTFPNSSPGLR  150
     ||||||||||||||||||||||||||||||||||||||||||||||||||
101  YAWDSTYRKFSTKVTLNTVGHHHRPPPHQASVSGIQAELLTFPNSSPGLR  150

151  RQKRDWVIPPISCPENEKGPFPKNLVQIKSNKDKEGKVFYSITGQGADTP  200
     ||||||||||||||||||||||||||||||||||||||||||||||||||
151  RQKRDWVIPPISCPENEKGPFPKNLVQIKSNKDKEGKVFYSITGQGADTP  200

201  PVGVFIIERETGWLKVTEPLDRERIATYTLFSHAVSSNGNAVEDPMEILI  250
     ||||||||||||||||||||||||||||||||||||||||||||||||||
201  PVGVFIIERETGWLKVTEPLDRERIATYTLFSHAVSSNGNAVEDPMEILI  250

251  TVTDQNDNKPEFTQEVFKGSVMEG                           274
     ||||||||||||||||||||||||
251  TVTDQNDNKPEFTQEVFKGSVMEG                           274
```

Sequence name: /tmp/2x0I2XZlA3/JXvUszCm3O:CAD1_HUMAN

```
1    MGPWSRSLSALLLLLQVSSWLCQEPEPCHPGFDAESYTFTVPRRHLERGR  50
     ||||||||||||||||||||||||||||||||||||||||||||||||||
1    MGPWSRSLSALLLLLQVSSWLCQEPEPCHPGFDAESYTFTVPRRHLERGR  50
```

```
 51 VLGRVNFEDCTGRQRTAYFSLDTRFKVGTDGVITVKRPLRFHNPQIHFLV 100
    |||||||||||||||||||||||||||||||||||||||||||||||||
 51 VLGRVNFEDCTGRQRTAYFSLDTRFKVGTDGVITVKRPLRFHNPQIHFLV 100

101 YAWDSTYRKFSTKVTLNTVGHHHRPPPHQASVSGIQAELLTFPNSSPGLR 150
    |||||||||||||||||||||||||||||||||||||||||||||||||
101 YAWDSTYRKFSTKVTLNTVGHHHRPPPHQASVSGIQAELLTFPNSSPGLR 150

151 RQKRDWVIPPISCPENEKGPFPKNLVQIKSNKDKEGKVFYSITGQGADTP 200
    |||||||||||||||||||||||||||||||||||||||||||||||||
151 RQKRDWVIPPISCPENEKGPFPKNLVQIKSNKDKEGKVFYSITGQGADTP 200

201 PVGVFIIERETGWLKVTEPLDRERIATYTLFSHAVSSNGNAVEDPMEILI 250
    |||||||||||||||||||||||||||||||||||||||||||||||||
201 PVGVFIIERETGWLKVTEPLDRERIATYTLFSHAVSSNGNAVEDPMEILI 250

251 TVTDQNDNKPEFTQEVFKGSVMEG                          274
    ||||||||||||||||||||||||
251 TVTDQNDNKPEFTQEVFKGSVMEG                          274
```

Sequence name: /tmp/e5Y8HiBmjB/iwybld81kl:Q9UII7 (SEQ ID NO: 963)

Identity: 100.00
Gaps: 0

Sequence documentation:

Alignment:

```
  1 MGPWSRSLSALLLLLQVSSWLCQEPEPCHPGFDAESYTFTVPRRHLERGR  50
    |||||||||||||||||||||||||||||||||||||||||||||||||
  1 MGPWSRSLSALLLLLQVSSWLCQEPEPCHPGFDAESYTFTVPRRHLERGR  50

51 VLGRVNFEDCTGRQRTAYFSLDTRFKVGTDGVITVKRPLRFHNPQIHFLV 100
    |||||||||||||||||||||||||||||||||||||||||||||||||
 51 VLGRVNFEDCTGRQRTAYFSLDTRFKVGTDGVITVKRPLRFHNPQIHFLV 100

101 YAWDSTYRKFSTKVTLNTVGHHHRPPPHQASVSGIQAELLTFPNSSPGLR 150
    |||||||||||||||||||||||||||||||||||||||||||||||||
101 YAWDSTYRKFSTKVTLNTVGHHHRPPPHQASVSGIQAELLTFPNSSPGLR 150

151 RQKRDWVIPPISCPENEKGPFPKNLVQIKSNKDKEGKVFYSITGQGADTP 200
    |||||||||||||||||||||||||||||||||||||||||||||||||
151 RQKRDWVIPPISCPENEKGPFPKNLVQIKSNKDKEGKVFYSITGQGADTP 200

201 PVGVFIIERETGWLKVTEPLDRERIATYTLFSHAVSSNGNAVEDPMEILI 250
    |||||||||||||||||||||||||||||||||||||||||||||||||
201 PVGVFIIERETGWLKVTEPLDRERIATYTLFSHAVSSNGNAVEDPMEILI 250

251 TVTDQNDNKPEFTQEVFKGSVMEGALPGTSVMEVTATDADDDVNTYNAAI 300
    |||||||||||||||||||||||||||||||||||||||||||||||||
251 TVTDQNDNKPEFTQEVFKGSVMEGALPGTSVMEVTATDADDDVNTYNAAI 300

301 AYTILSQDPELPDKNMFTINRNTGVISVVTTGLDRESFPTYTLVVQAADL 350
    |||||||||||||||||||||||||||||||||||||||||||||||||
301 AYTILSQDPELPDKNMFTINRNTGVISVVTTGLDRESFPTYTLVVQAADL 350

351 QGEGLSTTATAVITVTDTNDNPPIFNPTT                     379
    |||||||||||||||||||||||||||||
351 QGEGLSTTATAVITVTDTNDNPPIFNPTT                     379
```

Alignment of: HSECADH_P13 (SEQ ID NO: 97) x Q9UII7 (SEQ ID NO: 963) . . .

Alignment segment 1/1:
  Quality: 3720.00

Escore: 0
  Matching length: 379 Total length: 379

Matching Percent Similarity: 100.00 Matching Percent Identity: 100.00

Total Percent Similarity: 100.00 Total Percent

Sequence name: /tmp/e5Y8HiBmjB/iwybld81kl:Q9UII8 (SEQ ID NO: 964)

Sequence documentation:

Alignment of: HSECADH_P13 (SEQ ID NO: 97) x Q9UII8 (SEQ ID NO: 964) . . .

Alignment segment 1/1:
  Quality: 3720.00

Escore: 0
  Matching length: 379 Total length: 379

Matching Percent Similarity: 100.00 Matching Percent Identity: 100.00
  Total Percent Similarity: 100.00 Total Percent Identity: 100.00
  Gaps: 0

Alignment:

```
  1 MGPWSRSLSALLLLLQVSSWLCQEPEPCHPGFDAESYTFTVPRRHLERGR    50
    |||||||||||||||||||||||||||||||||||||||||||||||||||
  1 MGPWSRSLSALLLLLQVSSWLCQEPEPCHPGFDAESYTFTVPRRHLERGR    50

51 VLGRVNFEDCTGRQRTAYFSLDTRFKVGTDGVITVKRPLRFHNPQIHFLV   100
    |||||||||||||||||||||||||||||||||||||||||||||||||||
 51 VLGRVNFEDCTGRQRTAYFSLDTRFKVGTDGVITVKRPLRFHNPQIHFLV   100

101 YAWDSTYRKFSTKVTLNTVGHHHRPPPHQASVSGIQAELLTFPNSSPGLR   150
    |||||||||||||||||||||||||||||||||||||||||||||||||||
101 YAWDSTYRKFSTKVTLNTVGHHHRPPPHQASVSGIQAELLTFPNSSPGLR   150

151 RQKRDWVIPPISCPENEKGPFPKNLVQIKSNKDKEGKVFYSITGQGADTP   200
    |||||||||||||||||||||||||||||||||||||||||||||||||||
151 RQKRDWVIPPISCPENEKGPFPKNLVQIKSNKDKEGKVFYSITGQGADTP   200

201 PVGVFIIERETGWLKVTEPLDRERIATYTLFSHAVSSNGNAVEDPMEILI   250
    |||||||||||||||||||||||||||||||||||||||||||||||||||
201 PVGVFIIERETGWLKVTEPLDRERIATYTLFSHAVSSNGNAVEDPMEILI   250

251 TVTDQNDNKPEFTQEVFKGSVMEGALPGTSVMEVTATDADDDVNTYNAAI   300
    |||||||||||||||||||||||||||||||||||||||||||||||||||
251 TVTDQNDNKPEFTQEVFKGSVMEGALPGTSVMEVTATDADDDVNTYNAAI   300

301 AYTILSQDPELPDKNMFTINRNTGVISVVTTGLDRESFPTYTLVVQAADL   350
    |||||||||||||||||||||||||||||||||||||||||||||||||||
301 AYTILSQDPELPDKNMFTINRNTGVISVVTTGLDRESFPTYTLVVQAADL   350

351 QGEGLSTTATAVITVTDTNDNPPIFNPTT                         379
    |||||||||||||||||||||||||||||
351 QGEGLSTTATAVITVTDTNDNPPIFNPTT                         379
```

Sequence name: /tmp/e5Y8HiBmjB/iwybld81kl: CAD1_HUMAN

Sequence documentation:

Alignment of: HSECADH_P13 (SEQ ID NO: 97) x CAD1_HUMAN ...

Alignment segment 1/1:

Quality: 3720.00
Escore: 0
  Matching length: 379 Total length: 379
Matching Percent Similarity: 100.00 Matching Percent Identity: 100.00
Total Percent Similarity: 100.00 Total Percent Identity: 100.00
Gaps: 0

Alignment:

```
  1 MGPWSRSLSALLLLLQVSSWLCQEPEPCHPGFDAESYTFTVPRRHLERGR    50
    |||||||||||||||||||||||||||||||||||||||||||||||||||
  1 MGPWSRSLSALLLLLQVSSWLCQEPEPCHPGFDAESYTFTVPRRHLERGR    50

51 VLGRVNFEDCTGRQRTAYFSLDTRFKVGTDGVITVKRPLRFHNPQIHFLV   100
    |||||||||||||||||||||||||||||||||||||||||||||||||||
 51 VLGRVNFEDCTGRQRTAYFSLDTRFKVGTDGVITVKRPLRFHNPQIHFLV   100

101 YAWDSTYRKFSTKVTLNTVGHHHRPPPHQASVSGIQAELLTFPNSSPGLR   150
    |||||||||||||||||||||||||||||||||||||||||||||||||||
101 YAWDSTYRKFSTKVTLNTVGHHHRPPPHQASVSGIQAELLTFPNSSPGLR   150

151 RQKRDWVIPPISCPENEKGPFPKNLVQIKSNKDKEGKVFYSITGQGADTP   200
    |||||||||||||||||||||||||||||||||||||||||||||||||||
151 RQKRDWVIPPISCPENEKGPFPKNLVQIKSNKDKEGKVFYSITGQGADTP   200

201 PVGVFIIERETGWLKVTEPLDRERIATYTLFSHAVSSNGNAVEDPMEILI   250
    |||||||||||||||||||||||||||||||||||||||||||||||||||
201 PVGVFIIERETGWLKVTEPLDRERIATYTLFSHAVSSNGNAVEDPMEILI   250
```

-continued

```
251  TVTDQNDNKPEFTQEVFKGSVMEGALPGTSVMEVTATDADDDVNTYNAAI  300
     |||||||||||||||||||||||||||||||||||||||||||||||||
251  TVTDQNDNKPEFTQEVFKGSVMEGALPGTSVMEVTATDADDDVNTYNAAI  300

301  AYTILSQDPELPDKNMFTINRNTGVISVVTTGLDRESFPTYTLVVQAADL  350
     |||||||||||||||||||||||||||||||||||||||||||||||||
301  AYTILSQDPELPDKNMFTINRNTGVISVVTTGLDRESFPTYTLVVQAADL  350

351  QGEGLSTTATAVITVTDTNDNPPIFNPTT                      379
     ||||||||||||||||||||||||||||
351  QGEGLSTTATAVITVTDTNDNPPIFNPTT                      379
```

Sequence name: /tmp/RtiX8vFyZe/iovNeRHKWU:Q9UII7 (SEQ ID NO: 963)

Sequence documentation:

Alignment of: HSECADH_P14 (SEQ ID NO: 98) x Q9UII7 (SEQ ID NO: 963) . . .

Alignment segment 1/1:
 Quality: 3313.00

Escore: 0
 Matching length: 336 Total length: 336

Percent Similarity: 100.00 Matching Percent Identity: 100.00
Total Percent Similarity: 100.00 Total Percent Identity: 100.00
Gaps: 0

Alignment:

Sequence name: /tmp/RtiX8vFyZe/iovNeRHKWU:Q9UII8 (SEQ ID NO: 964)

Sequence documentation:

Alignment of: HSECADH_P14 (SEQ ID NO: 98) x Q9UII8 (SEQ ID NO: 964) . . .

Alignment segment 1/1:
 Quality: 3313.00

Escore: 0
 Matching length: 336 Total length: 336

Matching Percent Similarity: 100.00 Matching Percent Identity: 100.00
Total Percent Similarity: 100.00 Total Percent Identity: 100.00
Gaps: 0

```
  1  MGPWSRSLSALLLLLQVSSWLCQEPEPCHPGFDAESYTFTVPRRHLERGR   50
     |||||||||||||||||||||||||||||||||||||||||||||||||
  1  MGPWSRSLSALLLLLQVSSWLCQEPEPCHPGFDAESYTFTVPRRHLERGR   50

51  VLGRVNFEDCTGRQRTAYFSLDTRFKVGTDGVITVKRPLRFHNPQIHFLV  100
     |||||||||||||||||||||||||||||||||||||||||||||||||
 51  VLGRVNFEDCTGRQRTAYFSLDTRFKVGTDGVITVKRPLRFHNPQIHFLV  100

101  YAWDSTYRKFSTKVTLNTVGHHHRPPPHQASVSGIQAELLTFPNSSPGLR  150
     |||||||||||||||||||||||||||||||||||||||||||||||||
101  YAWDSTYRKFSTKVTLNTVGHHHRPPPHQASVSGIQAELLTFPNSSPGLR  150

151  RQKRDWVIPPISCPENEKGPFPKNLVQIKSNKDKEGKVFYSITGQGADTP  200
     |||||||||||||||||||||||||||||||||||||||||||||||||
151  RQKRDWVIPPISCPENEKGPFPKNLVQIKSNKDKEGKVFYSITGQGADTP  200

201  PVGVFIIERETGWLKVTEPLDRERIATYTLFSHAVSSNGNAVEDPMEILI  250
     |||||||||||||||||||||||||||||||||||||||||||||||||
201  PVGVFIIERETGWLKVTEPLDRERIATYTLFSHAVSSNGNAVEDPMEILI  250

251  TVTDQNDNKPEFTQEVFKGSVMEGALPGTSVMEVTATDADDDVNTYNAAI  300
     |||||||||||||||||||||||||||||||||||||||||||||||||
251  TVTDQNDNKPEFTQEVFKGSVMEGALPGTSVMEVTATDADDDVNTYNAAI  300

301  AYTILSQDPELPDKNMFTINRNTGVISVVTTGLDRE               336
     ||||||||||||||||||||||||||||||||||||
301  AYTILSQDPELPDKNMFTINRNTGVISVVTTGLDRE               336
```

Alignment:

```
  1  MGPWSRSLSALLLLLQVSSWLCQEPEPCHPGFDAESYTFTVPRRHLERGR   50
     |||||||||||||||||||||||||||||||||||||||||||||||||
  1  MGPWSRSLSALLLLLQVSSWLCQEPEPCHPGFDAESYTFTVPRRHLERGR   50

51  VLGRVNFEDCTGRQRTAYFSLDTRFKVGTDGVITVKRPLRFHNPQIHFLV  100
     |||||||||||||||||||||||||||||||||||||||||||||||||
 51  VLGRVNFEDCTGRQRTAYFSLDTRFKVGTDGVITVKRPLRFHNPQIHFLV  100

101  YAWDSTYRKFSTKVTLNTVGHHHRPPPHQASVSGIQAELLTFPNSSPGLR  150
     |||||||||||||||||||||||||||||||||||||||||||||||||
101  YAWDSTYRKFSTKVTLNTVGHHHRPPPHQASVSGIQAELLTFPNSSPGLR  150

151  RQKRDWVIPPISCPENEKGPFPKNLVQIKSNKDKEGKVFYSITGQGADTP  200
     |||||||||||||||||||||||||||||||||||||||||||||||||
151  RQKRDWVIPPISCPENEKGPFPKNLVQIKSNKDKEGKVFYSITGQGADTP  200

201  PVGVFIIERETGWLKVTEPLDRERIATYTLFSHAVSSNGNAVEDPMEILI  250
     |||||||||||||||||||||||||||||||||||||||||||||||||
201  PVGVFIIERETGWLKVTEPLDRERIATYTLFSHAVSSNGNAVEDPMEILI  250

251  TVTDQNDNKPEFTQEVFKGSVMEGALPGTSVMEVTATDADDDVNTYNAAI  300
     |||||||||||||||||||||||||||||||||||||||||||||||||
251  TVTDQNDNKPEFTQEVFKGSVMEGALPGTSVMEVTATDADDDVNTYNAAI  300

301  AYTILSQDPELPDKNMFTINRNTGVISVVTTGLDRE                336
     |||||||||||||||||||||||||||||||||||
301  AYTILSQDPELPDKNMFTINRNTGVISVVTTGLDRE                336
```

Sequence name: /tmp/RtiX8vFyZe/iovNeRHKWU: CAD1_HUMAN

Sequence documentation:

Alignment of: HSECADH_P14 (SEQ ID NO: 98) x CAD1_HUMAN . . .

Alignment segment 1/1:
    Quality: 3313.00
Escore: 0
    Matching length: 336 Total length: 336

Matching Percent Similarity: 100.00 Matching Percent Identity: 100.00

Total Percent Similarity: 100.00 Total Percent Identity: 100.00

Gaps: 0

Alignment:

```
  1  MGPWSRSLSALLLLLQVSSWLCQEPEPCHPGFDAESYTFTVPRRHLERGR   50
     |||||||||||||||||||||||||||||||||||||||||||||||||
  1  MGPWSRSLSALLLLLQVSSWLCQEPEPCHPGFDAESYTFTVPRRHLERGR   50

51  VLGRVNFEDCTGRQRTAYFSLDTRFKVGTDGVITVKRPLRFHNPQIHFLV  100
     |||||||||||||||||||||||||||||||||||||||||||||||||
 51  VLGRVNFEDCTGRQRTAYFSLDTRFKVGTDGVITVKRPLRFHNPQIHFLV  100

101  YAWDSTYRKFSTKVTLNTVGHHHRPPPHQASVSGIQAELLTFPNSSPGLR  150
     |||||||||||||||||||||||||||||||||||||||||||||||||
101  YAWDSTYRKFSTKVTLNTVGHHHRPPPHQASVSGIQAELLTFPNSSPGLR  150

151  RQKRDWVIPPISCPENEKGPFPKNLVQIKSNKDKEGKVFYSITGQGADTP  200
     |||||||||||||||||||||||||||||||||||||||||||||||||
151  RQKRDWVIPPISCPENEKGPFPKNLVQIKSNKDKEGKVFYSITGQGADTP  200

201  PVGVFIIERETGWLKVTEPLDRERIATYTLFSHAVSSNGNAVEDPMEILI  250
     |||||||||||||||||||||||||||||||||||||||||||||||||
201  PVGVFIIERETGWLKVTEPLDRERIATYTLFSHAVSSNGNAVEDPMEILI  250

251  TVTDQNDNKPEFTQEVFKGSVMEGALPGTSVMEVTATDADDDVNTYNAAI  300
     |||||||||||||||||||||||||||||||||||||||||||||||||
251  TVTDQNDNKPEFTQEVFKGSVMEGALPGTSVMEVTATDADDDVNTYNAAI  300
```

-continued

```
301  AYTILSQDPELPDKNMFTINRNTGVISVVTTGLDRE     336
     ||||||||||||||||||||||||||||||||||||
301  AYTILSQDPELPDKNMFTINRNTGVISVVTTGLDRE     336
```

Sequence name: /tmp/rMRrwmuokD/1rmk2jOfgw:Q9UII7 (SEQ ID NO: 963)

Sequence documentation:

Alignment of: HSECADH_P15 (SEQ ID NO: 99) x Q9UII7 (SEQ ID NO: 963) . . .

Alignment segment 1/1:
 Quality: 2289.00

Escore: 0
 Matching length: 229 Total length: 229

Matching Percent Similarity: 100.00 Matching Percent Identity: 100.00
 Total Percent Similarity: 100.00 Total Percent Identity: 100.00
 Gaps: 0

Alignment:

```
  1  MGPWSRSLSALLLLLQVSSWLCQEPEPCHPGFDAESYTFTVPRRHLERGR    50
     ||||||||||||||||||||||||||||||||||||||||||||||||||
  1  MGPWSRSLSALLLLLQVSSWLCQEPEPCHPGFDAESYTFTVPRRHLERGR    50

51  VLGRVNFEDCTGRQRTAYFSLDTRFKVGTDGVITVKRPLRFHNPQIHFLV   100
     ||||||||||||||||||||||||||||||||||||||||||||||||||
 51  VLGRVNFEDCTGRQRTAYFSLDTRFKVGTDGVITVKRPLRFHNPQIHFLV   100

101  YAWDSTYRKFSTKVTLNTVGHHHRPPPHQASVSGIQAELLTFPNSSPGLR   150
     ||||||||||||||||||||||||||||||||||||||||||||||||||
101  YAWDSTYRKFSTKVTLNTVGHHHRPPPHQASVSGIQAELLTFPNSSPGLR   150

151  RQKRDWVIPPISCPENEKGPFPKNLVQIKSNKDKEGKVFYSITGQGADTP   200
     ||||||||||||||||||||||||||||||||||||||||||||||||||
151  RQKRDWVIPPISCPENEKGPFPKNLVQIKSNKDKEGKVFYSITGQGADTP   200

201  PVGVFIIERETGWLKVTEPLDRERIATYT                       229
     |||||||||||||||||||||||||||||
201  PVGVFIIERETGWLKVTEPLDRERIATYT                       229
```

Sequence name: /tmp/rMRrwmuokD/1rmk2jOfgw:Q9UII8 (SEQ ID NO: 964)

Sequence documentation:

Alignment of: HSECADH_P15 (SEQ ID NO: 99) x Q9UII8 (SEQ ID NO: 964) . . .

Alignment segment 1/1:
 Quality: 2289.00

Escore: 0
 Matching length: 229 Total length: 229

Matching Percent Similarity: 100.00 Matching Percent Identity: 100.00
 Total Percent Similarity: 100.00 Total Percent Identity: 100.00
 Gaps: 0

Alignment:

```
  1  MGPWSRSLSALLLLLQVSSWLCQEPEPCHPGFDAESYTFTVPRRHLERGR    50
     ||||||||||||||||||||||||||||||||||||||||||||||||||
  1  MGPWSRSLSALLLLLQVSSWLCQEPEPCHPGFDAESYTFTVPRRHLERGR    50

51  VLGRVNFEDCTGRQRTAYFSLDTRFKVGTDGVITVKRPLRFHNPQIHFLV   100
     ||||||||||||||||||||||||||||||||||||||||||||||||||
 51  VLGRVNFEDCTGRQRTAYFSLDTRFKVGTDGVITVKRPLRFHNPQIHFLV   100

101  YAWDSTYRKFSTKVTLNTVGHHHRPPPHQASVSGIQAELLTFPNSSPGLR   150
     ||||||||||||||||||||||||||||||||||||||||||||||||||
101  YAWDSTYRKFSTKVTLNTVGHHHRPPPHQASVSGIQAELLTFPNSSPGLR   150

151  RQKRDWVIPPISCPENEKGPFPKNLVQIKSNKDKEGKVFYSITGQGADTP   200
     ||||||||||||||||||||||||||||||||||||||||||||||||||
151  RQKRDWVIPPISCPENEKGPFPKNLVQIKSNKDKEGKVFYSITGQGADTP   200
```

```
201  PVGVFIIERETGWLKVTEPLDRERIATYT              229
     |||||||||||||||||||||||||||||
201  PVGVFIIERETGWLKVTEPLDRERIATYT              229
```

Sequence name: /tmp/rMRrwmuokD/1rmk2jOfgw:CAD1_HUMAN

Sequence documentation:

Alignment of: HSECADH_P15 (SEQ ID NO: 99) x CAD1_HUMAN...

Alignment segment 1/1:
  Quality: 2289.00

Escore: 0
  Matching length: 229 Total length: 229

Matching Percent Similarity: 100.00 Matching Percent

Identity: 100.00
  Total Percent Similarity: 100.00 Total Percent

Identity: 100.00
  Gaps: 0

Alignment:

```
  1  MGPWSRSLSALLLLLQVSSWLCQEPEPCHPGFDAESYTFTVPRRHLERGR   50
     ||||||||||||||||||||||||||||||||||||||||||||||||||
  1  MGPWSRSLSALLLLLQVSSWLCQEPEPCHPGFDAESYTFTVPRRHLERGR   50

51  VLGRVNFEDCTGRQRTAYFSLDTRFKVGTDGVITVKRPLRFHNPQIHFLV  100
     ||||||||||||||||||||||||||||||||||||||||||||||||||
 51  VLGRVNFEDCTGRQRTAYFSLDTRFKVGTDGVITVKRPLRFHNPQIHFLV  100

101  YAWDSTYRKFSTKVTLNTVGHHHRPPPHQASVSGIQAELLTFPNSSPGLR  150
     ||||||||||||||||||||||||||||||||||||||||||||||||||
101  YAWDSTYRKFSTKVTLNTVGHHHRPPPHQASVSGIQAELLTFPNSSPGLR  150

151  RQKRDWVIPPISCPENEKGPFPKNLVQIKSNKDKEGKVFYSITGQGADTP  200
     ||||||||||||||||||||||||||||||||||||||||||||||||||
151  RQKRDWVIPPISCPENEKGPFPKNLVQIKSNKDKEGKVFYSITGQGADTP  200

201  PVGVFIIERETGWLKVTEPLDRERIATYT              229
     |||||||||||||||||||||||||||||
201  PVGVFIIERETGWLKVTEPLDRERIATYT              229
```

DESCRIPTION FOR CLUSTER HUMGRP5E

Cluster HUMGRP5E features 2 transcript(s) and 5 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| HUMGRP5E_T4 (SEQ ID NO:100) | 100 |
| HUMGRP5E_T5 (SEQ ID NO:101) | 101 |

TABLE 2

Segments of interest

| Segment Name | SEQ ID NO: |
|---|---|
| HUMGRP5E_node_0 (SEQ ID NO:102) | 102 |
| HUMGRP5E_node_2 (SEQ ID NO:103) | 103 |
| HUMGRP5E_node_8 (SEQ ID NO:104) | 104 |
| HUMGRP5E_node_3 (SEQ ID NO:105) | 105 |
| HUMGRP5E_node_7 (SEQ ID NO:106) | 106 |

TABLE 3

Proteins of interest

| Protein Name | SEQ ID NO: |
|---|---|
| HUMGRP5E_P4 (SEQ ID NO:108) | 108 |
| HUMGRP5E_P5 (SEQ ID NO:109) | 109 |

These sequences are variants of the known protein Gastrin-releasing peptide precursor (SwissProt accession identifier GRP_HUMAN; known also according to the synonyms GRP; GRP-10), SEQ ID NO: 107, referred to herein as the previously known protein.

Gastrin-releasing peptide is known or believed to have the following function(s): stimulates gastrin release as well as other gastrointestinal hormones. The sequence for protein Gastrin-releasing peptide precursor is given at the end of the application, as "Gastrin-releasing peptide precursor amino acid sequence". Known polymorphisms for this sequence are as shown in Table 4.

TABLE 4

Amino acid mutations for Known Protein

| SNP position(s) on amino acid sequence | Comment |
|---|---|
| 4 | S - >R |

Protein Gastrin-releasing peptide localization is believed to be Secreted. The previously known protein also has the following indication(s) and/or potential therapeutic use(s): Diabetes, Type II. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Bombesin antagonist; Insulinotropin agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anorectic/Antiobesity; Releasing hormone; Anticancer; Respiratory; Antidiabetic.

The following GO Annotation(s) apply to the previously known protein. The following annotation(s) were found: signal transduction; neuropeptide signaling pathway, which are annotation(s) related to Biological Process; growth factor, which are annotation(s) related to Molecular Function; and secreted, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

As noted above, cluster HUMGRP5E features 2 transcript(s), which were listed in Table 1 above. These transcript(s) encode for protein(s) which are variant(s) of protein Gastrin-releasing peptide precursor. A description of each variant protein according to the present invention is now provided.

Variant protein HUMGRP5E_P4 (SEQ ID NO: 108) according to the present invention has an amino acid sequence as given at the end of the application; it is encoded by transcript(s) HUMGRP5E_T4 (SEQ ID NO: 100). An alignment is given to the known protein (Gastrin-releasing peptide precursor) at the end of the application. One or more alignments to one or more previously published protein sequences are given at the end of the application. A brief description of the relationship of the variant protein according to the present invention to each such aligned protein is as follows:

Comparison report between HUMGRP5E_P4 (SEQ ID NO: 108) and GRP_HUMAN:

1. An isolated chimeric polypeptide encoding for HUMGRP5E_P4 (SEQ ID NO: 108), comprising a first amino acid sequence being at least 90% homologous to MRGSELPLVLLALVLCLAPRGRAV-PLPAGGGTVLTKMYPRGNHWAVGHLMGKKSTG ESSSVSERGSLKQQLREYIRWEEAARN-LLGLIEAKENRNHQPPQPKALGNQQPSWDSED SSN-FKDVGSKGK corresponding to amino acids 1-127 of GRP_HUMAN, which also corresponds to amino acids 1-127 of HUMGRP5E_P4 (SEQ ID NO: 108), and a second amino acid sequence being at least 90% homologous to GSQREGRNPQLNQQ corresponding to amino acids 135-148 of GRP_HUMAN, which also corresponds to amino acids 128-141 of HUMGRP5E_P4 (SEQ ID NO: 108), wherein said first and second amino acid sequences are contiguous and in a sequential order.

2. An isolated chimeric polypeptide encoding for an edge portion of HUMGRP5E_P4 (SEQ ID NO: 108), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KG, having a structure as follows: a sequence starting from any of amino acid numbers 127–x to 127; and ending at any of amino acid numbers 128+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGRP5E_P4 (SEQ ID NO: 108) also has the following non-silent SNPs (Single Nucleotide Polymorphisms) as listed in Table 5, (given according to their position(s) on the amino acid sequence, with the alternative amino acid(s) listed; the last column indicates whether the SNP is known or not; the presence of known SNPs in variant protein HUMGRP5E_P4 (SEQ ID NO: 108) sequence provides support for the deduced sequence of this variant protein according to the present invention).

TABLE 5

Amino acid mutations

| SNP position(s) on amino acid sequence | Alternative amino acid(s) | Previously known SNP? |
|---|---|---|
| 4 | S - >R | Yes |

Variant protein HUMGRP5E_P4 (SEQ ID NO: 108) is encoded by the following transcript(s): HUMGRP5E_T4 (SEQ ID NO: 100), for which the sequence(s) is/are given at the end of the application. The coding portion of transcript HUMGRP5E_T4 (SEQ ID NO: 100) is shown in bold; this coding portion starts at position 622 and ends at position 1044. The transcript also has the following SNPs as listed in Table 6 (given according to their position on the nucleotide sequence, with the alternative nucleic acid listed; the last column indicates whether the SNP is known or not; the presence of known SNPs in variant protein HUMGRP5E_P4 (SEQ ID NO: 108) sequence provides support for the deduced sequence of this variant protein according to the present invention).

TABLE 6

Nucleic acid SNPs

| SNP position on nucleotide sequence | Alternative nucleic acid | Previously known SNP? |
|---|---|---|
| 541 | – >T | No |
| 542 | G – >T | No |
| 631 | A – >C | Yes |
| 672 | G – >A | Yes |
| 1340 | C – > | No |
| 1340 | C – >A | No |
| 1341 | A – > | No |
| 1341 | A – >G | No |

Variant protein HUMGRP5E_P5 (SEQ ID NO: 109) according to the present invention has an amino acid sequence as given at the end of the application; it is encoded by transcript(s) HUMGRP5E_T5 (SEQ ID NO: 101). An alignment is given to the known protein (Gastrin-releasing peptide precursor) at the end of the application. One or more alignments to one or more previously published protein sequences are given at the end of the application. A brief description of the relationship of the variant protein according to the present invention to each such aligned protein is as follows:

Comparison report between HUMGRP5E_P5 (SEQ ID NO: 109) and GRP_HUMAN:

1. An isolated chimeric polypeptide encoding for HUMGRP5E_P5 (SEQ ID NO: 109), comprising a first amino acid sequence being at least 90% homologous to MRGSELPLVLLALVLCLAPRGRAV-PLPAGGGTVLTKMYPRGNHWAVGHLMGKKSTG
20 ESSSVSERGSLKQQLREYIRWEEAARN-LLGLIEAKENRNHQPPQPKALGNQQPSWDSED SSN-FKDVGSKGK corresponding to amino acids 1-127 of GRP_HUMAN, which also corresponds to amino acids 1-127 of HUMGRP5E_P5 (SEQ ID NO: 109), and a second amino acid sequence being at least 70%, optionally at least 80%, preferably at least 85%, more preferably at least 90% and most preferably at least 95% homologous to a polypeptide having the sequence DSLLQVLNVKEGTPS (SEQ ID NO: 1125) corresponding to amino acids 128-142 of HUMGRP5E_P5 (SEQ ID NO: 109), wherein said first and second amino acid sequences are contiguous and in a sequential order.

2. An isolated polypeptide encoding for a tail of HUMGRP5E_P5 (SEQ ID NO: 109), comprising a polypeptide being at least 70%, optionally at least about 80%, preferably at least about 85%, more preferably at least about 90% and most preferably at least about 95% homologous to the sequence DSLLQVLNVKEGTPS (SEQ ID NO: 1125) in HUMGRP5E_P5 (SEQ ID NO: 109).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGRP5E_P5 (SEQ ID NO: 109) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein HUMGRP5E_P5 (SEQ ID NO: 109) sequence provides support for the deduced sequence of this variant protein according to the present invention).

TABLE 7

Amino acid mutations

| SNP position(s) on amino acid sequence | Alternative amino acid(s) | Previously known SNP? |
|---|---|---|
| 4 | S -> R | Yes |

Variant protein HUMGRP5E P5 (SEQ ID NO: 109) is encoded by the following transcript(s): HUMGRP5E_T5 (SEQ ID NO: 101), for which the sequence(s) is/are given at the end of the application. The coding portion of transcript HUMGRP5E_T5 (SEQ ID NO: 101) is shown in bold; this coding portion starts at position 622 and ends at position 1047. The transcript also has the following SNPs as listed in Table 8 (given according to their position on the nucleotide sequence, with the alternative nucleic acid listed; the last column indicates whether the SNP is known or not; the presence of known SNPs in variant protein HUMGRP5E_P5 (SEQ ID NO: 109) sequence provides support for the deduced sequence of this variant protein according to the present invention).

TABLE 8

Nucleic acid SNPs

| SNP position on nucleotide sequence | Alternative nucleic acid | Previously known SNP? |
|---|---|---|
| 541 | -> T | No |
| 542 | G -> T | No |
| 631 | A -> C | Yes |
| 672 | G -> A | Yes |
| 1354 | C -> | No |
| 1354 | C -> A | No |
| 1355 | A -> | No |
| 1355 | A -> G | No |

As noted above, cluster HUMGRP5E features 5 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMGRP5E_node_0 (SEQ ID NO: 102) according to the present invention is supported by 21 libraries. The number of libraries was determined as previously described. This segment can be found in the following transcript(s): HUMGRP5E_T4 (SEQ ID NO: 100) and HUMGRP5E_T5 (SEQ ID NO: 101). Table 9 below describes the starting and ending position of this segment on each transcript.

TABLE 9

Segment location on transcripts

| Transcript name | Segment starting position | Segment ending position |
|---|---|---|
| HUMGRP5E_T4 (SEQ ID NO:100) | 1 | 760 |
| HUMGRP5E_T5 (SEQ ID NO:101) | 1 | 760 |

Segment cluster HUMGRP5E_node_2 (SEQ ID NO: 103) according to the present invention is supported by 27 libraries. The number of libraries was determined as previously described. This segment can be found in the following transcript(s): HUMGRP5E_T4 (SEQ ID NO: 100) and HUMGRP5E_T5 (SEQ ID NO: 101). Table 10 below describes the starting and ending position of this segment on each transcript.

TABLE 10

Segment location on transcripts

| Transcript name | Segment starting position | Segment ending position |
|---|---|---|
| HUMGRP5E_T4 (SEQ ID NO:100) | 761 | 984 |
| HUMGRP5E_T5 (SEQ ID NO:101) | 761 | 984 |

Segment cluster HUMGRP5E_node_8 (SEQ ID NO: 104) according to the present invention is supported by 26 libraries. The number of libraries was determined as previously described. This segment can be found in the following transcript(s): HUMGRP5E_T4 (SEQ ID NO: 100) and HUMGRP5E_T5 (SEQ ID NO: 101). Table 11 below describes the starting and ending position of this segment on each transcript.

TABLE 11

Segment location on transcripts

| Transcript name | Segment starting position | Segment ending position |
|---|---|---|
| HUMGRP5E_T4 (SEQ ID NO:100) | 1004 | 1362 |
| HUMGRP5E_T5 (SEQ ID NO:101) | 1018 | 1376 |

According to an optional embodiment of the present invention, short segments related to the above cluster are also provided. These segments are up to about 120 bp in length, and so are included in a separate description.

Segment cluster HUMGRP5E_node_3 (SEQ ID NO: 105) according to the present invention can be found in the following transcript(s): HUMGRP5E_T4 (SEQ ID NO: 100) and HUMGRP5E_T5 (SEQ ID NO: 101). Table 12 below describes the starting and ending position of this segment on each transcript.

TABLE 12

Segment location on transcripts

| Transcript name | Segment starting position | Segment ending position |
|---|---|---|
| HUMGRP5E_T4 (SEQ ID NO:100) | 985 | 1003 |
| HUMGRP5E_T5 (SEQ ID NO:101) | 985 | 1003 |

Segment cluster HUMGRP5E_node_7 (SEQ ID NO: 106) according to the present invention can be found in the following transcript(s): HUMGRP5E_T5 (SEQ ID NO: 101). Table 13 below describes the starting and ending position of this segment on each transcript.

TABLE 13

Segment location on transcripts

| Transcript name | Segment starting position | Segment ending position |
|---|---|---|
| HUMGRP5E_T5 (SEQ ID NO:101) | 1004 | 1017 |

Variant protein alignment to the previously known protein:

Sequence name: /tmp/412zs2mwyT/B0wjOUAX0d:GRP_HUMAN

Sequence documentation:

Alignment of: HUMGRP5E_P4 (SEQ ID NO: 108) x GRP_HUMAN . . .

Alignment segment 1/1:
　Quality: 1291.00

Escore: 0
　Matching length: 141 Total length: 148

Matching Percent Similarity: 100.00 Matching Percent

Identity: 100.00
　Total Percent Similarity: 95.27 Total Percent

Identity: 95.27
　Gaps: 1

Alignment:

```
1  MRGSELPLVLLALVLCLAPRGRAVPLPAGGGTVLTKMYPRGNHWAVGHLM  50
   |||||||||||||||||||||||||||||||||||||||||||||||||
1  MRGSELPLVLLALVLCLAPRGRAVPLPAGGGTVLTKMYPRGNHWAVGHLM  50
```

-continued

```
 51  GKKSTGESSSVSERGSLKQQLREYIRWEEAARNLLGLIEAKENRNHQPPQ  100
     |||||||||||||||||||||||||||||||||||||||||||||||||
 51  GKKSTGESSSVSERGSLKQQLREYIRWEEAARNLLGLIEAKENRNHQPPQ  100

101  PKALGNQQPSWDSEDSSNFKDVGSKGK.......GSQREGRNPQLNQQ    141
     ||||||||||||||||||||||||||       |||||||||||||||
101  PKALGNQQPSWDSEDSSNFKDVGSKGKVGRLSAPGSQREGRNPQLNQQ    148
```

Sequence name: /tmp/1me9ldnvfv/KbP5io8PtU:GRP_HUMAN

Sequence documentation:

Alignment of: HUMGRP5E_P5 (SEQ ID NO: 109) x GRP_HUMAN . . .

Alignment segment 1/1:
Quality: 1248.00

Escore: 0
Matching length: 127 Total length: 127

Matching Percent Similarity: 100.00 Matching Percent

Identity: 100.00
Total Percent Similarity: 100.00 Total Percent

Identity: 100.00
Gaps: 0

Alignment:

```
  1  MRGSELPLVLLALVLCLAPRGRAVPLPAGGGTVLTKMYPRGNHWAVGHLM   50
     ||||||||||||||||||||||||||||||||||||||||||||||||||
  1  MRGSELPLVLLALVLCLAPRGRAVPLPAGGGTVLTKMYPRGNHWAVGHLM   50

51  GKKSTGESSSVSERGSLKQQLREYIRWEEAARNLLGLIEAKENRNHQPPQ  100
     |||||||||||||||||||||||||||||||||||||||||||||||||
 51  GKKSTGESSSVSERGSLKQQLREYIRWEEAARNLLGLIEAKENRNHQPPQ  100

101  PKALGNQQPSWDSEDSSNFKDVGSKGK                         127
     ||||||||||||||||||||||||||
101  PKALGNQQPSWDSEDSSNFKDVGSKGK                         127
```

Expression of GRP_HUMAN—gastrin-releasing peptide HUMGRP5E transcripts which are detectable by amplicon as depicted in sequence name HUMGRP5E junc3-7 (SEQ ID NO:967) in normal and cancerous ovary tissues Expression of GRP_HUMAN—gastrin-releasing peptide transcripts detectable by or according to junc3-7, HUMGRP5Ejunc3-7 amplicon(s) (SEQ ID NO:967) and HUMGRP5Ejunc3-7F (SEQ ID NO:965) and HUMGRP5Ejunc3-7R (SEQ ID NO:966) primers was measured by real time PCR. In parallel the expression of four housekeeping genes PBGD (GenBank Accession No. BC019323, (SEQ ID NO: 1036); amplicon—PBGD-amplicon, (SEQ ID NO: 1039)), HPRT1 (GenBank Accession No. NM_000194, (SEQ ID NO:1040); amplicon—HPRT1-amplicon, (SEQ ID NO: 1043) and SDHA (GenBank Accession No. NM_004168, (SEQ ID NO: 1032); amplicon—SDHA-amplicon, (SEQ ID NO: 1035)), GAPDH (GenBank Accession No. BC026907, (SEQ ID NO: 1044); GAPDH amplicon, (SEQ ID NO: 1047)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample No 45-48, 71 Table 1 above, "Tissue samples in testing panel"), to obtain a value of fold up-regulation for each sample relative to median of the normal PM samples.

Figure 13:
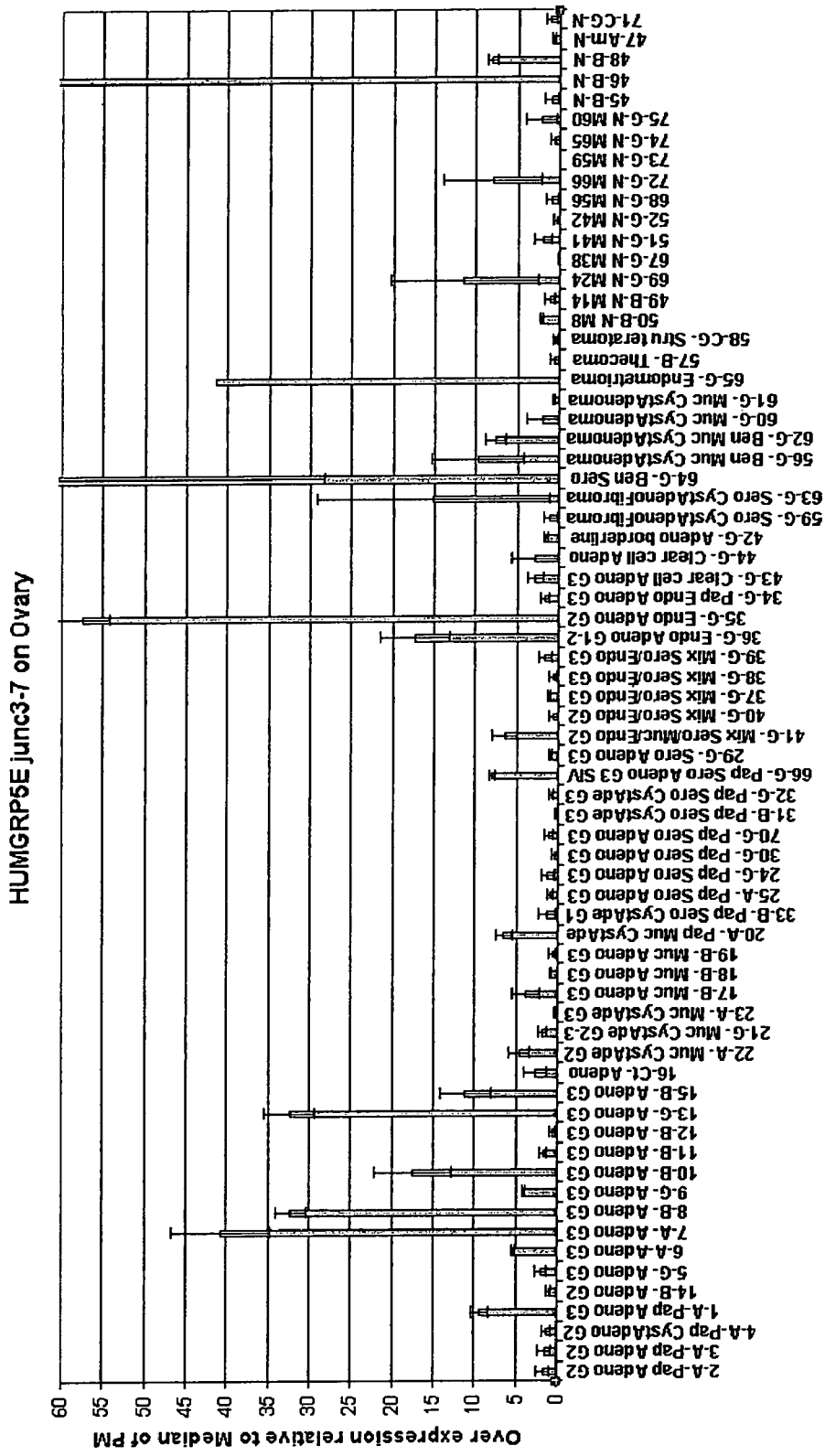
FIG. 13 is a histogram showing over expression of HUMGRP5Ejunc3-7 (SEQ ID NO:967) transcripts in cancerous ovary samples relative to the normal samples.

FIG. 13 is a histogram showing over expression of the above-indicated GRP_HUMAN—gastrin-releasing peptide transcripts in cancerous ovary samples relative to the normal samples. Values represent the average of duplicate experiments. Error bars indicate the minimal and maximal values obtained). As is evident from FIG. 13, the expression of GRP_HUMAN—gastrin-releasing peptide transcripts detectable by the above amplicon(s) in several cancer samples was higher in several cancerous samples than in the non-cancerous samples (Sample No. 45, 47-48, 71 Table 1 above, "Tissue samples in testing panel") and including benign samples (samples No. 57-62 Table 1 above, "Tissue samples in testing panel"). Notably an over-expression of at least 5 fold was found in 13 out of 43 adenocarcinoma samples.

Primer pairs are also optionally and preferably encompassed within the present invention; for example, for the above experiment, the following primer pair was used as a non-limiting illustrative example only of a suitable primer pair: HUMGRP5Ejunc3-7F (SEQ ID NO:965) forward primer; and HUMGRP5Ejunc3-7R (SEQ ID NO:966) reverse primer.

The present invention also preferably encompasses any amplicon obtained through the use of any suitable primer pair; for example, for the above experiment, the following amplicon was obtained as a non-limiting illustrative example only of a suitable amplicon: HUMGRP5Ejunc3-7 (SEQ ID NO:967).

HUMGRP5Ejunc3-7F (SEQ ID NO:965)
ACCAGCCACCTCAACCCA
HUMGRP5Ejunc3-7R (SEQ ID NO:966)
CTGGAGCAGAGAGTCTTTGCCT
HUMGRP5Ejunc3-7 (SEQ ID NO:967)

ACCAGCCACCTCAACCCAAGGC-
CCTGGGCAATCAGCAGCCTTCGTGGGATTCAGAG
GATAGCAGCAACTTCAAAGATGTAGGT-
TCAAAAGGCAAAGACTCTCTGCTCCAG

Expression of GRP_HUMAN—gastrin-releasing peptide HUMGRP5E transcripts, which are detectable by amplicon as depicted in sequence name HUMGRP5E junc3-7 (SEQ ID NO:967) in different normal tissues.

Expression of GRP_HUMAN—gastrin-releasing peptide transcripts detectable by or according to HUMGRP5E junc3-7 amplicon(s) (SEQ ID NO:967) and HUMGRP5E junc3-7F (SEQ ID NO:965) and HUMGRP5Ejunc3-7R (SEQ ID NO:966) was measured by real time PCR. In parallel the expression of four housekeeping genes—RPL19 (GenBank Accession No. NM_000981, (SEQ ID NO:1048); RPL19 amplicon, (SEQ ID NO:1051)), TATA box (GenBank Accession No. NM_003194, (SEQ ID NO:1052); TATA amplicon, (SEQ ID NO:1055)), Ubiquitin (GenBank Accession No. BC000449, (SEQ ID NO: 1056); amplicon—Ubiquitin-amplicon, (SEQ ID NO: 1059)) and SDHA (GenBank Accession No. NM_004168, (SEQ ID NO: 1032); amplicon—SDHA-amplicon, (SEQ ID NO: 1035)) was measured similarly. For each RT sample, the expression of the above amplicon was normalized to the geometric mean of the quantities of the housekeeping genes. The normalized quantity of each RT sample was then divided by the median of the quantities of the breast samples (Sample Nos. 33-35 above), to obtain a value of relative expression of each sample relative to median of the breast samples.

Figure 14:
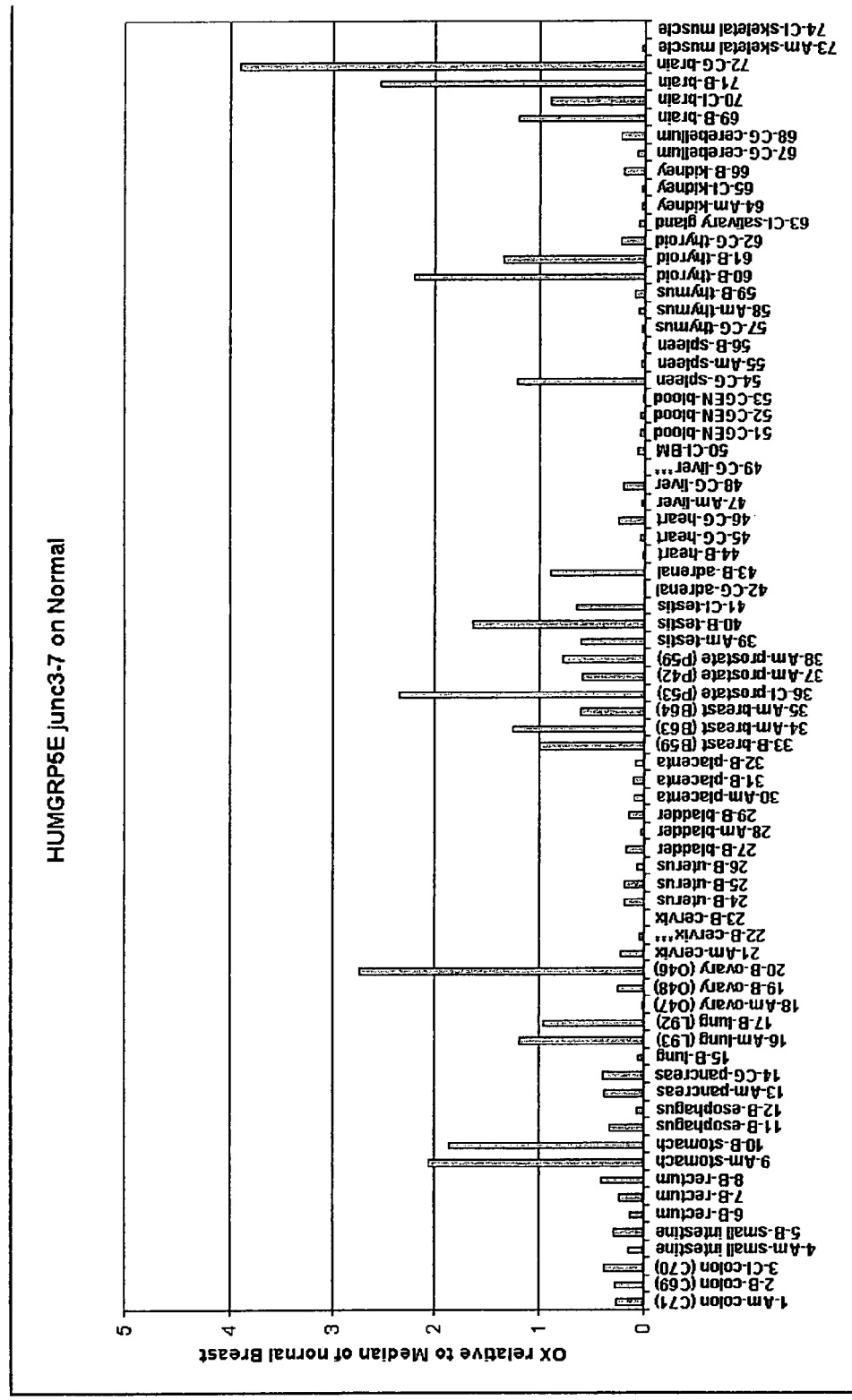
FIG. 14 is a histogram showing expression of HUMGRP5Ejunc3-7 (SEQ ID NO:967) transcripts in normal tissues.

The results are described in FIG. 14, presenting the histogram showing the expression of HUMGRP5E transcripts, which are detectable by amplicon as depicted in sequence name HUMGRP5E junc3-7 (SEQ ID NO:967), in different normal tissues. Primers and amplicons are as above.

DESCRIPTION FOR CLUSTER R11723

Cluster R11723 features 6 transcript(s) and 26 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| R11723_PEA_1_T15 | 110 |
| R11723_PEA_1_117 | 111 |
| R11723_PEA_1_T19 | 112 |
| R11723_PEA_1_T20 | 113 |
| R11723_PEA_1_T5 | 114 |
| R11723_PEA_1_T6 | 115 |

TABLE 2

Segments of interest

| Segment Name | SEQ ID NO: |
|---|---|
| R11723_PEA_1_node_13 | 116 |
| R11723_PEA_1_node_16 | 117 |
| R11723_PEA_1_node_19 | 118 |
| R11723_PEA_1_node_2 | 119 |
| R11723_PEA_1_node_22 | 120 |
| R11723_PEA_1_node_31 | 121 |
| R11723_PEA_1_node_10 | 122 |

TABLE 2-continued

Segments of interest

| Segment Name | SEQ ID NO: |
|---|---|
| R11723_PEA_1_node_11 | 123 |
| R11723_PEA_1_node_15 | 124 |
| R11723_PEA_1_node_18 | 125 |
| R11723_PEA_1_node_20 | 126 |
| R11723_PEA_1_node_21 | 127 |
| R11723_PEA_1_node_23 | 128 |
| R11723_PEA_1_node_24 | 129 |
| R11723_PEA_1_node_25 | 130 |
| R11723_PEA_1_node_26 | 131 |
| R11723_PEA_1_node_27 | 132 |
| R11723_PEA_1_node_28 | 133 |
| R11723_PEA_1_node_29 | 134 |
| R11723_PEA_1_node_3 | 135 |
| R11723_PEA_1_node_30 | 136 |
| R11723_PEA_1_node_4 | 137 |
| R11723_PEA_1_node_5 | 138 |
| R11723_PEA_1_node_6 | 139 |
| R11723_PEA_1_node_7 | 140 |
| R11723_PEA_1_node_8 | 141 |

TABLE 3

Proteins of interest

| Protein Name | SEQ ID NO: |
|---|---|
| R11723_PEA_1_P2 | 142 |
| R11723_PEA_1_P6 | 143 |
| R11723_PEA_1_P7 | 144 |
| R11723_PEA_1_P13 | 145 |
| R11723_PEA_1_P10 | 146 |

Cluster R11723 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 15 refer to weighted expression of ESTs in each category, as "parts per million" (ratio of the expression of ESTs for a particular cluster to the expression of all ESTs in that category, according to parts per million).

Figure 15:
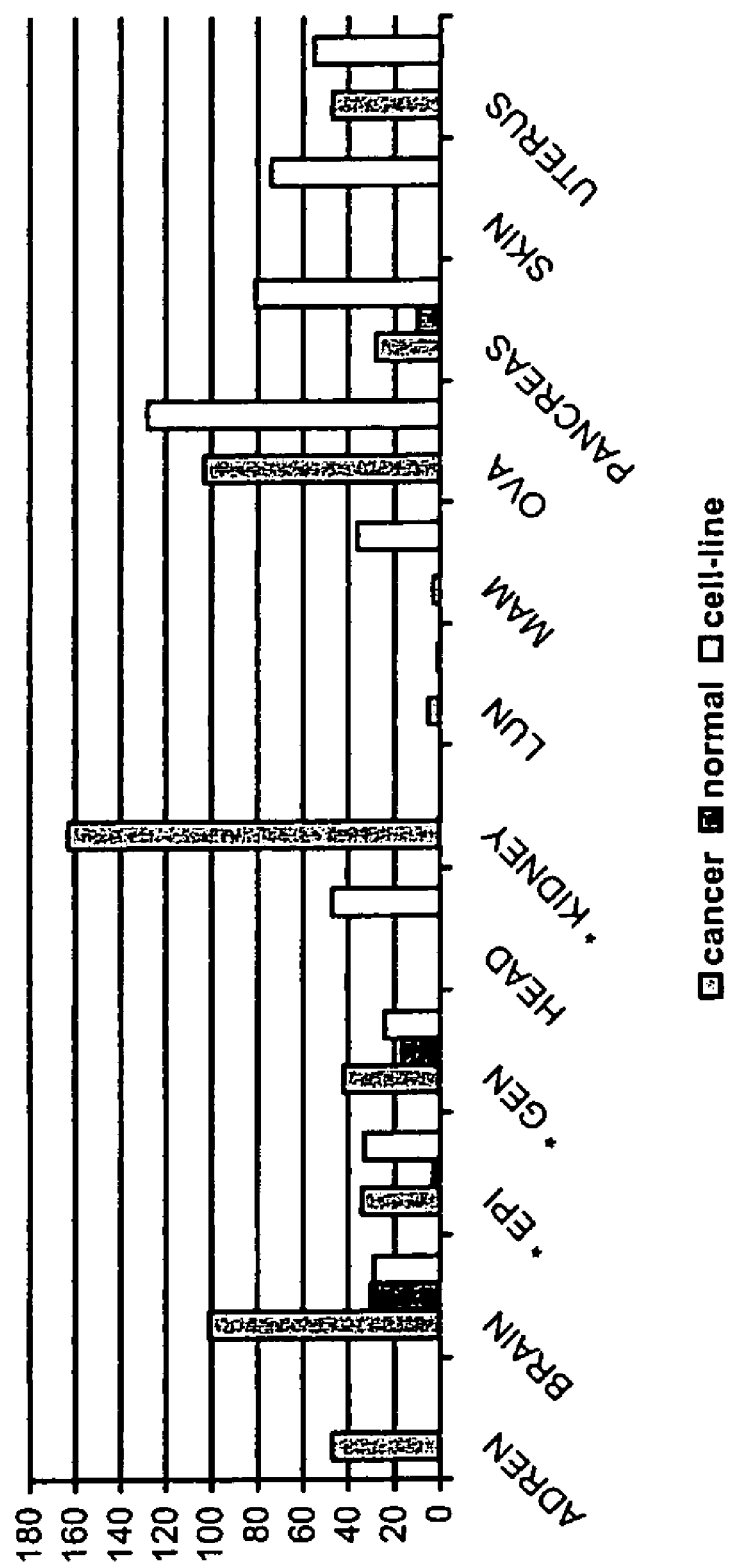
FIG. 15 shows cancer and cell-line vs. normal tissue expression.

Overall, the following results were obtained as shown with regard to the histograms in FIG. 15 and Table 4. This cluster is overexpressed (at least at a minimum level) in the following pathological conditions: epithelial malignant tumors, a mixture of malignant tumors from different tissues and kidney malignant tumors.

TABLE 4

Normal tissue distribution

| Name of Tissue | Number |
|---|---|
| adrenal | 0 |
| brain | 30 |
| epithelial | 3 |
| general | 17 |
| head and neck | 0 |
| kidney | 0 |
| lung | 0 |
| breast | 0 |
| ovary | 0 |
| pancreas | 10 |
| skin | 0 |
| uterus | 0 |

TABLE 5

P values and ratios for expression in cancerous tissue

| Name of Tissue | P1 | P2 | SP1 | R3 | SP2 | R4 |
|---|---|---|---|---|---|---|
| adrenal | 4.2e−01 | 4.6e−01 | 4.6e−01 | 2.2 | 5.3e−01 | 1.9 |
| brain | 2.2e−01 | 2.0e−01 | 1.2e−02 | 2.8 | 5.0e−02 | 2.0 |
| epithelial | 3.0e−05 | 6.3e−05 | 1.8e−05 | 6.3 | 3.4e−06 | 6.4 |
| general | 7.2e−03 | 4.0e−02 | 1.3e−04 | 2.1 | 1.1e−03 | 1.7 |
| head and neck | 1 | 5.0e−01 | 1 | 1.0 | 7.5e−01 | 1.3 |
| kidney | 1.5e−01 | 2.4e−01 | 4.4e−03 | 5.4 | 2.8e−02 | 3.6 |
| lung | 1.2e−01 | 1.6e−01 | 1 | 1.6 | 1 | 1.3 |
| breast | 5.9e−01 | 4.4e−01 | 1 | 1.1 | 6.8e−01 | 1.5 |
| ovary | 1.6e−02 | 1.3e−02 | 1.0e−01 | 3.8 | 7.0e−02 | 3.5 |
| pancreas | 5.5e−01 | 2.0e−01 | 3.9e−01 | 1.9 | 1.4e−01 | 2.7 |
| skin | 1 | 4.4e−01 | 1 | 1.0 | 1.9e−02 | 2.1 |
| uterus | 1.5e−02 | 5.4e−02 | 1.9e−01 | 3.1 | 1.4e−01 | 2.5 |

It should be noted that the variants of this cluster are variants of the hypothetical protein PSEC0181 (referred to herein as "PSEC"). Furthermore, use of the known protein (WT protein) for detection of ovarian cancer, alone or in combination with one or more variants of this cluster and/or of any other cluster and/or of any known marker, also comprises an embodiment of the present invention. As described in greater detail below, in ovarian cancer, the variants of the present invention show a similar expression patter to that of PSEC, except that at least one variant shows greater overexpression than PSEC in ovarian cancer.

As noted above, cluster R11723 features 6 transcript(s), which were listed in Table 1 above. A description of each variant protein according to the present invention is now provided.

Variant protein R11723_PEA_1_P2 (SEQ ID NO: 142) according to the present invention has an amino acid sequence as given at the end of the application; it is encoded by transcript(s) R11723_PEA_1_T6 (SEQ ID NO: 115). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P2 (SEQ ID NO: 142) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein R11723_PEA_1_P2 (SEQ ID NO: 142) sequence provides support for the deduced sequence of this variant protein according to the present invention).

TABLE 6

Amino acid mutations

| SNP position(s) on amino acid sequence | Alternative amino acid(s) | Previously known SNP? |
|---|---|---|
| 107 | H -> P | Yes |
| 70 | G -> | No |
| 70 | G -> C | No |

Variant protein R11723_PEA_1_P2 (SEQ ID NO: 142) is encoded by the following transcript(s): R11723_PEA_1_T6 (SEQ ID NO: 115), for which the sequence(s) is/are given at the end of the application. The coding portion of transcript R11723_PEA_1_T6 (SEQ ID NO: 115) is shown in bold; this coding portion starts at position 1716 and ends at position 2051. The transcript also has the following SNPs as listed in Table 7 (given according to their position on the nucleotide sequence, with the alternative nucleic acid listed; the last column indicates whether the SNP is known or not; the presence of known SNPs in variant protein R11723_PEA_1_P2 (SEQ ID NO: 142) sequence provides support for the deduced sequence of this variant protein according to the present invention).

TABLE 7

Nucleic acid SNPs

| SNP position on nucleotide sequence | Alternative nucleic acid | Previously known SNP? |
|---|---|---|
| 1231 | C -> T | Yes |
| 1278 | G -> C | Yes |
| 1923 | G -> | No |
| 1923 | G -> T | No |
| 2035 | A -> C | Yes |
| 2048 | A -> C | No |
| 2057 | A -> G | Yes |

Variant protein R11723_PEA_1_P6 (SEQ ID NO: 143) according to the present invention has an amino acid sequence as given at the end of the application; it is encoded by transcript(s) R11723_PEA_1_T15 (SEQ ID NO: 110). One or more alignments to one or more previously published protein sequences are given at the end of the application. A brief description of the relationship of the variant protein according to the present invention to each such aligned protein is as follows:

Comparison report between R11723_PEA_1_P6 (SEQ ID NO: 143) and Q8IXM0 (SEQ ID NO: 968) (SEQ ID NO:968):

1. An isolated chimeric polypeptide encoding for R11723_PEA_1_P6 (SEQ ID NO: 143), comprising a first amino acid sequence being at least 70%, optionally at least 80%, preferably at least 85%, more preferably at least 90% and most preferably at least 95% homologous to a polypeptide having the sequence MWVLGIAATFCGLFLLPGFAL-QIQCYQCEEFQLNNDCSSPEFIVNCTVN-VQDMCQKEV MEQSAGIMYRKSCASSAACLIASAG-SPCRGLAPGREEQRALHKAGAVGGGVR (SEQ ID NO: 1126) corresponding to amino acids 1-110 of R11723_PEA_1_P6 (SEQ ID NO: 143), and a second amino acid sequence being at least 90% homologous to MYAQALLVVGV-LQRQAAAQHLHEHPPKLLRGHRVQERVD-DRAEVEKRLREGEEDHV RPEVGPRPVVLGFGRSHD-PPNLVGHPAYGQCHNNQPWADTSRRERQRKEKHSM RTQ corresponding to amino acids 1-112 of Q8IXM0 (SEQ ID NO: 968), which also corresponds to amino acids 111-222 of R11723_PEA_1_P6 (SEQ ID NO: 143), wherein said first and second amino acid sequences are contiguous and in a sequential order.

2. An isolated polypeptide encoding for a head of R11723_PEA_1_P6 (SEQ ID NO: 143), comprising a polypeptide being at least 70%, optionally at least about 80%, preferably at least about 85%, more preferably at least about 90% and most preferably at least about 95% homologous to the sequence MWVLGIAATFCGLFLLPGFALQIQCYQ-CEEFQLNNDCSSPEFIVNCTVNVQDMCQKEV MEQSAGIMYRKSCASSAACLIASAG- SPCRGLAPGREEQRALHKAGAVGGGVR (SEQ ID NO: 1126) of R11723_PEA_1_P6 (SEQ ID NO: 143).

Comparison report between R11723_PEA_1_P6 (SEQ ID NO: 143) and Q96AC2 (SEQ ID NO: 969) (SEQ ID NO:969):

1. An isolated chimeric polypeptide encoding for R11723_PEA_1_P6 (SEQ ID NO: 143), comprising a first amino acid sequence being at least 90% homologous to MWVLGIAATFCGLFLLPGFALQIQCYQ-CEEFQLNNDCSSPEFIVNCTVNVQDMCQKEV MEQSAGIMYRKSCASSAACLIASAG corresponding to amino acids 1-83 of Q96AC2 (SEQ ID NO: 969), which also corresponds to amino acids 1-83 of R11723_PEA_1_P6 (SEQ ID NO: 143), and a second amino acid sequence being at least 70%, optionally at least 80%, preferably at least 85%, more preferably at least 90% and most preferably at least 95% homologous to a polypeptide having the sequence SPCR-GLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO: 1127) corresponding to amino acids 84-222 of R11723_PEA_1_P6 (SEQ ID NO: 143), wherein said first and second amino acid sequences are contiguous and in a sequential order.

2. An isolated polypeptide encoding for a tail of R11723_PEA_1_P6 (SEQ ID NO: 143), comprising a polypeptide being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO: 1127) in R11723_PEA_1_P6 (SEQ ID NO: 143).

Comparison report between R11723_PEA_1_P6 (SEQ ID NO: 143) and Q8N2G4 (SEQ ID NO: 970) (SEQ ID NO:970):

1. An isolated chimeric polypeptide encoding for R11723_PEA_1_P6 (SEQ ID NO: 143), comprising a first amino acid sequence being at least 90% homologous to MWVLGIAATFCGLFLLPGFALQIQCYQ-CEEFQLNNDCSSPEFIVNCTVNVQDMCQKEV MEQSAGIMYRKSCASSAACLIASAG corresponding to amino acids 1-83 of Q8N2G4 (SEQ ID NO: 970), which also corresponds to amino acids 1-83 of R11723_PEA_1_P6 (SEQ ID NO: 143), and a second amino acid sequence being at least 70%, optionally at least 80%, preferably at least 85%, more preferably at least 90% and most preferably at least 95% homologous to a polypeptide having the sequence SPCR-GLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO: 1127) corresponding to amino acids 84-222 of R11723_PEA_1_P6 (SEQ ID NO: 143), wherein said first and second amino acid sequences are contiguous and in a sequential order.

2. An isolated polypeptide encoding for a tail of R11723_PEA_1_P6 (SEQ ID NO: 143), comprising a polypeptide being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ, ID NO:1127) in R11723_PEA_1_P6 (SEQ ID NO: 143).

Comparison report between R11723_PEA_1_P6 (SEQ ID NO: 143) and BAC85518 (SEQ ID NO: 971) (SEQ ID NO:971):

1. An isolated chimeric polypeptide encoding for R11723_PEA_1_P6 (SEQ ID NO: 143), comprising a first amino acid sequence being at least 90% homologous to MWVLGIAATFCGLFLLPGFALQIQCYQ-CEEFQLNNDCSSPEFIVNCTVNVQDMCQKEV MEQSAGIMYRKSCASSAACLIASAG corresponding to amino acids 24-106 of BAC85518 (SEQ ID NO: 971), which also corresponds to amino acids 1-83 of R11723_PEA_1_P6 (SEQ ID NO: 143), and a second amino acid sequence being at least 70%, optionally at least 80%, preferably at least 85%, more preferably at least 90% and most preferably at least 95% homologous to a polypeptide having the sequence SPCR-GLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO: 1127) corresponding to amino acids 84-222 of R11723_PEA_1_P6 (SEQ ID NO: 143), wherein said first and second amino acid sequences are contiguous and in a sequential order.

2. An isolated polypeptide encoding for a tail of R11723_PEA_1_P6 (SEQ ID NO: 143), comprising a polypeptide being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO: 1127) in R11723_PEA_1_P6 (SEQ ID NO: 143).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P6 (SEQ ID NO: 143) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein R11723_PEA_1_P6 (SEQ ID NO: 143) sequence provides support for the deduced sequence of this variant protein according to the present invention).

TABLE 8

Amino acid mutations

| SNP position(s) on amino acid sequence | Alternative amino acid(s) | Previously known SNP? |
|---|---|---|
| 180 | G -> | No |
| 180 | G -> C | No |
| 217 | H -> P | Yes |

Variant protein R11723_PEA_1_P6 (SEQ ID NO: 143) is encoded by the following transcript(s): R11723_PEA_1_T15 (SEQ ID NO: 110), for which the sequence(s) is/are given at the end of the application. The coding portion of transcript R11723_PEA_1_T15 (SEQ ID NO: 110) is shown in bold; this coding portion starts at position 434 and ends at position 1099. The transcript also has the following SNPs as listed in Table 9 (given according to their position on the nucleotide sequence, with the alternative nucleic acid listed; the last column indicates whether the SNP is known or not; the presence of known SNPs in variant protein R11723_PEA_1_P6 (SEQ ID NO: 143) sequence provides support for the deduced sequence of this variant protein according to the present invention).

TABLE 9

Nucleic acid SNPs

| SNP position on nucleotide sequence | Alternative nucleic acid | Previously known SNP? |
|---|---|---|
| 971 | G -> | No |
| 971 | G -> T | No |
| 1083 | A -> C | Yes |
| 1096 | A -> C | No |
| 1105 | A -> G | Yes |

Variant protein R11723_PEA_1_P7 (SEQ ID NO: 144) according to the present invention has an amino acid sequence as given at the end of the application; it is encoded by transcript(s) R11723_PEA_1_T17 (SEQ ID NO: 111). One or more alignments to one or more previously published protein sequences are given at the end of the application. A brief description of the relationship of the variant protein according to the present invention to each such aligned protein is as follows:

Comparison report between R11723_PEA_1_P7 (SEQ ID NO: 144) and Q96AC2 (SEQ ID NO: 969):

1. An isolated chimeric polypeptide encoding for R11723_PEA_1_P7 (SEQ ID NO: 144), comprising a first amino acid sequence being at least 90% homologous to MWVLGIAATFCGLFLLPGFALQIQCYQ-CEEFQLNNDCSSPEFIVNCTVNVQDMCQKEV MEQSAG corresponding to amino acids 1-64 of Q96AC2 (SEQ ID NO: 969), which also corresponds to amino acids 1-64 of R11723_PEA_1_P7 (SEQ ID NO: 144), and a second amino acid sequence being at least 70%, optionally at least 80%, preferably at least 85%, more preferably at least 90% and most preferably at least 95% homologous to a polypeptide having the sequence SHCVTRLECSGTISAH-CNLCLPGSNDHPT (SEQ ID NO: 1128) corresponding to amino acids 65-93 of R11723_PEA_1_P7 (SEQ ID NO: 144), wherein said first and second amino acid sequences are contiguous and in a sequential order.

2. An isolated polypeptide encoding for a tail of R11723_PEA_1_P7 (SEQ ID NO: 144), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO: 1128) in R11723_PEA_1_P7 (SEQ ID NO: 144).

Comparison report between R11723_PEA_1_P7 (SEQ ID NO: 144) and Q8N2G4 (SEQ ID NO: 970):

1. An isolated chimeric polypeptide encoding for R11723_PEA_1_P7 (SEQ ID NO: 144), comprising a first amino acid sequence being at least 90% homologous to MWVLGIAATFCGLFLLPGFALQIQCYQ-CEEFQLNNDCSSPEFIVNCTVNVQDMCQKEV MEQSAG corresponding to amino acids 1-64 of Q8N2G4 (SEQ ID NO: 970), which also corresponds to amino acids 1-64 of R11723_PEA_1_P7 (SEQ ID NO: 144), and a second amino acid sequence being at least 70%, optionally at least 80%, preferably at least 85%, more preferably at least 90% and most preferably at least 95% homologous to a polypeptide having the sequence SHCVTRLECSGTISAH-CNLCLPGSNDHPT (SEQ ID NO: 1128) corresponding to amino acids 65-93 of R11723_PEA_1_P7 (SEQ ID NO: 144), wherein said first and second amino acid sequences are contiguous and in a sequential order.

2. An isolated polypeptide encoding for a tail of R11723_PEA_1_P7 (SEQ ID NO: 144), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO: 1128) in R11723_PEA_1_P7 (SEQ ID NO: 144).

Comparison report between R11723_PEA_1_P7 (SEQ ID NO: 144) and BAC85273 (SEQ ID NO: 972) (SEQ ID NO:972):

1. An isolated chimeric polypeptide encoding for R11723_PEA_1_P7 (SEQ ID NO: 144), comprising a first amino acid sequence being at least 70%, optionally at least 80%, preferably at least 85%, more preferably at least 90% and most preferably at least 95% homologous to a polypeptide having the sequence MWVLG (SEQ ID NO: 1129) corresponding to amino acids 1-5 of R11723_PEA_1_P7 (SEQ ID NO: 144), second amino acid sequence being at least 90% homologous to IAATFCGLFLLPGFALQIQCYQ-CEEFQLNNDCSSPEFIVNCTVNVQDMC-QKEVMEQSAG corresponding to amino acids 22-80 of BAC85273 (SEQ ID NO: 972), which also corresponds to amino acids 6-64 of R11723_PEA_1_P7 (SEQ ID NO: 144), and a third amino acid sequence being at least 70%, optionally at least 80%, preferably at least 85%, more preferably at least 90% and most preferably at least 95% homologous to a polypeptide having the sequence SHCVTRLECSGTISAH-CNLCLPGSNDHPT (SEQ ID NO: 1128) corresponding to amino acids 65-93 of R11723_PEA_1_P7 (SEQ ID NO: 144), wherein said first, second and third amino acid sequences are contiguous and in a sequential order.

2. An isolated polypeptide encoding for a head of R11723_PEA_1_P7 (SEQ ID NO: 144), comprising a polypeptide being at least 70%, optionally at least about 80%, preferably at least about 85%, more preferably at least about 90% and most preferably at least about 95% homologous to the sequence MWVLG (SEQ ID NO: 1129) of R11723_PEA_1_P7 (SEQ ID NO: 144).

3. An isolated polypeptide encoding for a tail of R11723_PEA_1_P7 (SEQ ID NO: 144), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO: 1128) in R11723_PEA_1_P7 (SEQ ID NO: 144).

Comparison report between R11723_PEA_1_P7 (SEQ ID NO: 144) and BAC85518 (SEQ ID NO: 971):

1. An isolated chimeric polypeptide encoding for R11723_PEA_1_P7 (SEQ ID NO: 144), comprising a first amino acid sequence being at least 90% homologous to MWVLGIAATFCGLFLLPGFALQIQCYQ-CEEFQLNNDCSSPEFIVNCTVNVQDMCQKEV MEQSAG corresponding to amino acids 24-87 of BAC85518 (SEQ ID NO: 971), which also corresponds to amino acids 1-64 of R11723_PEA_1_P7 (SEQ ID NO: 144), and a second amino acid sequence being at least 70%, optionally at least 80%, preferably at least 85%, more preferably at least 90% and most preferably at least 95% homologous to a polypeptide having the sequence SHCVTRLECSGTISAH-CNLCLPGSNDHPT (SEQ ID NO: 1128) corresponding to amino acids 65-93 of R11723_PEA_1_P7 (SEQ ID NO: 144), wherein said first and second amino acid sequences are contiguous and in a sequential order.

2. An isolated polypeptide encoding for a tail of R11723_PEA_1_P7 (SEQ ID NO: 144), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO: 1128) in R11723_PEA_1_P7 (SEQ ID NO: 144).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P7 (SEQ ID NO: 144) also has the following non-silent SNPs (Single Nucleotide Polymorphisms) as listed in Table 10, (given according to their position(s) on the amino acid sequence, with the alternative amino acid(s) listed; the last column indicates whether the SNP is known or not; the presence of known SNPs in variant protein R11723_PEA_1_P7 (SEQ ID NO: 144) sequence provides support for the deduced sequence of this variant protein according to the present invention).

TABLE 10

Amino acid mutations

| SNP position(s) on amino acid sequence | Alternative amino acid(s) | Previously known SNP? |
|---|---|---|
| 67 | C -> S | Yes |

Variant protein R11723_PEA_1_P7 (SEQ ID NO: 144) is encoded by the following transcript(s): R11723_PEA_1_T17 (SEQ ID NO: 11), for which the sequence(s) is/are given at the end of the application. The coding portion of transcript R11723_PEA_1_T17 (SEQ ID NO: 111) is shown in bold; this coding portion starts at position 434 and ends at position 712. The transcript also has the following SNPs as listed in Table 11 (given according to their position on the nucleotide sequence, with the alternative nucleic acid listed; the last column indicates whether the SNP is known or not; the presence of known SNPs in variant protein R11723_PEA_1_P7 (SEQ ID NO: 144) sequence provides support for the deduced sequence of this variant protein according to the present invention).

TABLE 11

| | Nucleic acid SNPs | |
|---|---|---|
| SNP position on nucleotide sequence | Alternative nucleic acid | Previously known SNP? |
| 625 | G -> T | Yes |
| 633 | G -> C | Yes |
| 1303 | C -> T | Yes |

Variant protein R11723_PEA_1_P13 (SEQ ID NO: 145) according to the present invention has an amino acid sequence as given at the end of the application; it is encoded by transcript(s) 19 and R11723_PEA_1_T5 (SEQ ID NO: 114). One or more alignments to one or more previously published protein sequences are given at the end of the application. A brief description of the relationship of the variant protein according to the present invention to each such aligned protein is as follows:

Comparison report between R11723_PEA_1_P13 (SEQ ID NO: 145) and Q96AC2 (SEQ ID NO: 969):

1. An isolated chimeric polypeptide encoding for R11723_PEA_1_P13 (SEQ ID NO: 145), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q96AC2 (SEQ ID NO: 969), which also corresponds to amino acids 1-63 of R11723_PEA_1_P13 (SEQ ID NO: 145), and a second amino acid sequence being at least 70%, optionally at least 80%, preferably at least 85%, more preferably at least 90% and most preferably at least 95% homologous to a polypeptide having the sequence DTKRTNTLLFEM-RHFAKQLTT (SEQ ID NO: 1130) corresponding to amino acids 64-84 of R11723_PEA_1_P13 (SEQ ID NO: 145), wherein said first and second amino acid sequences are contiguous and in a sequential order.

2. An isolated polypeptide encoding for a tail of R11723_PEA_1_P13 (SEQ ID NO: 145), comprising a polypeptide being at least 70%, optionally at least about 80%, preferably at least about 85%, more preferably at least about 90% and most preferably at least about 95% homologous to the sequence DTKRTNTLLFEMRHFAKQLTT (SEQ ID NO: 1130) in R11723_PEA_1_P13 (SEQ ID NO: 145).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P13 (SEQ ID NO: 145) is encoded by the following transcript(s): R11723_PEA_1_T19 (SEQ ID NO: 112), for which the sequence(s) is/are given at the end of the application. The coding portion of transcript R11723_PEA_1_T19 (SEQ ID NO: 112) is shown in bold; this coding portion starts at position 434 and ends at position 685. The transcript also has the following SNPs as listed in Table 12 (given according to their position on the nucleotide sequence, with the alternative nucleic acid listed; the last column indicates whether the SNP is known or not; the presence of known SNPs in variant protein R11723_PEA_1_P13 (SEQ ID NO: 145) sequence provides support for the deduced sequence of this variant protein according to the present invention).

TABLE 12

Nucleic acid SNPs

| SNP position on nucleotide sequence | Alternative nucleic acid | Previously known SNP? |
|---|---|---|
| 778 | G -> T | Yes |
| 786 | G -> C | Yes |
| 1456 | C -> T | Yes |

Variant protein R11723_PEA_1_P10 (SEQ ID NO: 146) according to the present invention has an amino acid sequence as given at the end of the application; it is encoded by transcript(s) R11723_PEA_1_T20 (SEQ ID NO: 113). One or more alignments to one or more previously published protein sequences are given at the end of the application. A brief description of the relationship of the variant protein according to the present invention to each such aligned protein is as follows:

Comparison report between R11723_PEA_1_P10 (SEQ ID NO: 146) and Q96AC2 (SEQ ID NO: 969):

1. An isolated chimeric polypeptide encoding for R11723_PEA_1_P10 (SEQ ID NO: 146), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q96AC2 (SEQ ID NO: 969), which also corresponds to amino acids 1-63 of R11723_PEA_1_P10 (SEQ ID NO: 146), and a second amino acid sequence being at least 70%, optionally at least 80%, preferably at least 85%, more preferably at least 90% and most preferably at least 95% homologous to a polypeptide having the sequence DRVSLCHEAGVQWNN-FSTLQPLPPRLK (SEQ ID NO: 1131) corresponding to amino acids 64-90 of R11723_PEA_1_P10 (SEQ ID NO: 146), wherein said first and second amino acid sequences are contiguous and in a sequential order.

2. An isolated polypeptide encoding for a tail of R11723_PEA_1_P10 (SEQ ID NO: 146), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO: 1131) in R11723_PEA_1_P10 (SEQ ID NO: 146).

Comparison report between R11723_PEA_1_P10 (SEQ ID NO: 146) and Q8N2G4 (SEQ ID NO: 970):

1. An isolated chimeric polypeptide encoding for R11723_PEA_1_P10 (SEQ ID NO: 146), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q8N2G4 (SEQ ID NO: 970), which also corresponds to amino acids 1-63 of R11723_PEA_1_P10 (SEQ ID NO: 146), and a second amino acid sequence being at least 70%, optionally at least 80%, preferably at least 85%, more preferably at least 90% and most preferably at least 95% homologous to a polypeptide having the sequence DRVSLCHEAGVQWNN-FSTLQPLPPRLK (SEQ ID NO: 1131) corresponding to amino acids 64-90 of R11723_PEA_1_P10 (SEQ ID NO: 146), wherein said first and second amino acid sequences are contiguous and in a sequential order.

2. An isolated polypeptide encoding for a tail of R11723_PEA_1_P10 (SEQ ID NO: 146), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO: 1131) in R11723_PEA_1_P10 (SEQ ID NO: 146).

Comparison report between R11723_PEA_1_P10 (SEQ ID NO: 146) and BAC85273 (SEQ ID NO: 972):

1. An isolated chimeric polypeptide encoding for R11723_PEA_1_P10 (SEQ ID NO: 146), comprising a first amino acid sequence being at least 70%, optionally at least 80%, preferably at least 85%, more preferably at least 90% and most preferably at least 95% homologous to a polypeptide having the sequence MWVLG (SEQ ID NO: 1129) corresponding to amino acids 1-5 of R11723_PEA_1_P10 (SEQ ID NO: 146), second amino acid sequence being at least 90% homologous to IAATFCGLFLLPGFALQIQCYQ-CEEFQLNNDCSSPEFIVNCTVNVQDMCQKEVMEQSA corresponding to amino acids 22-79 of BAC85273 (SEQ ID NO: 972), which also corresponds to amino acids 6-63 of R11723_PEA_1_P10 (SEQ ID NO: 146), and a third amino acid sequence being at least 70%, optionally at least 80%, preferably at least 85%, more preferably at least 90% and most preferably at least 95% homologous to a polypeptide having the sequence DRVSLCHEAGVQWNNFSTLQPLP-PRLK (SEQ ID NO: 1131) corresponding to amino acids 64-90 of R11723_PEA_1_P10 (SEQ ID NO: 146), wherein said first, second and third amino acid sequences are contiguous and in a sequential order.

2. An isolated polypeptide encoding for a head of R11723_PEA_1_P10 (SEQ ID NO: 146), comprising a polypeptide being at least 70%, optionally at least about 80%, preferably at least about 85%, more preferably at least about 90% and most preferably at least about 95% homologous to the sequence MWVLG (SEQ ID NO: 1129) of R11723_PEA_1_P10 (SEQ ID NO: 146).

3. An isolated polypeptide encoding for a tail of R11723_PEA_1_P10 (SEQ ID NO: 146), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO: 1131) in R11723_PEA_1_P10 (SEQ ID NO: 146).

Comparison report between R11723_PEA_1_P10 (SEQ ID NO: 146) and BAC85518 (SEQ ID NO: 971):

1. An isolated chimeric polypeptide encoding for R11723_PEA_1_P10 (SEQ ID NO: 146), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 24-86 of BAC85518 (SEQ ID NO: 971), which also corresponds to amino acids 1-63 of R11723_PEA_1_P10 (SEQ ID NO: 146), and a second amino acid sequence being at least 70%, optionally at least 80%, preferably at least 85%, more preferably at least 90% and most preferably at least 95% homologous to a polypeptide having the sequence DRVSLCHEAGVQWNN-FSTLQPLPPRLK (SEQ ID NO: 1131) corresponding to amino acids 64-90 of R11723_PEA_1_P10 (SEQ ID NO: 146), wherein said first and second amino acid sequences are contiguous and in a sequential order.

2. An isolated polypeptide encoding for a tail of R11723_PEA_1_P10 (SEQ ID NO: 146), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO: 1131) in R11723_PEA_1_P10 (SEQ ID NO: 146).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P10 (SEQ ID NO: 146) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein R11723_PEA_1_P10 (SEQ ID NO: 146) sequence provides support for the deduced sequence of this variant protein according to the present invention).

TABLE 13

Amino acid mutations

| SNP position(s) on amino acid sequence | Alternative amino acid(s) | Previously known SNP? |
|---|---|---|
| 66 | V -> F | Yes |

Variant protein R11723_PEA_1_P10 (SEQ ID NO: 146) is encoded by the following transcript(s): R11723_PEA_1_T20 (SEQ ID NO: 113), for which the sequence(s) is/are given at the end of the application. The coding portion of transcript R11723_PEA_1_T20 (SEQ ID NO: 113) is shown in bold; this coding portion starts at position 434 and ends at position 703. The transcript also has the following SNPs as listed in Table 14 (given according to their position on the nucleotide sequence, with the alternative nucleic acid listed; the last column indicates whether the SNP is known or not; the presence of known SNPs in variant protein R11723_PEA_1_P10 (SEQ ID NO: 146) sequence provides support for the deduced sequence of this variant protein according to the present invention).

TABLE 14

Nucleic acid SNPs

| SNP position on nucleotide sequence | Alternative nucleic acid | Previously known SNP? |
|---|---|---|
| 629 | G -> T | Yes |
| 637 | G -> C | Yes |
| 1307 | C -> T | Yes |

As noted above, cluster R11723 features 26 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster R11723_PEA_1_node_13 (SEQ ID NO: 116) according to the present invention is supported by 5 libraries. The number of libraries was determined as previously described. This segment can be found in the following transcript(s): R11723_PEA_1_T19 (SEQ ID NO: 112), R11723_PEA_1_T5 (SEQ ID NO: 114) and R11723_PEA_1_T6 (SEQ ID NO: 115). Table 15 below describes the starting and ending position of this segment on each transcript.

TABLE 15

Segment location on transcripts

| Transcript name | Segment starting position | Segment ending position |
|---|---|---|
| R11723_PEA_1_T19 (SEQ ID NO:112) | 624 | 776 |
| R11723_PEA_1_T5 (SEQ ID NO:114) | 624 | 776 |
| R11723_PEA_1_T6 (SEQ ID NO:115) | 658 | 810 |

Segment cluster R11723_PEA_1_node_16 (SEQ ID NO: 117) according to the present invention is supported by 3 libraries. The number of libraries was determined as previously described. This segment can be found in the following transcript(s): R11723_PEA_1_T17 (SEQ ID NO: 111), R11723_PEA_1_T19 (SEQ ID NO: 112) and R11723_PEA_1_T20 (SEQ ID NO: 113). Table 16 below describes the starting and ending position of this segment on each transcript.

TABLE 16

Segment location on transcripts

| Transcript name | Segment starting position | Segment ending position |
|---|---|---|
| R11723_PEA_1_T17 (SEQ ID NO:111) | 624 | 1367 |
| R11723_PEA_1_T19 (SEQ ID NO:112) | 777 | 1520 |
| R11723_PEA_1_T20 (SEQ ID NO:113) | 628 | 1371 |

Segment cluster R11723_PEA_1_node_19 (SEQ ID NO: 118) according to the present invention is supported by 45 libraries. The number of libraries was determined as previously described. This segment can be found in the following transcript(s): R11723_PEA_1_T5 (SEQ ID NO: 114) and R11723_PEA_1_T6 (SEQ ID NO: 115). Table 17 below describes the starting and ending position of this segment on each transcript.

TABLE 17

Segment location on transcripts

| Transcript name | Segment starting position | Segment ending position |
|---|---|---|
| R11723_PEA_1_T5 (SEQ ID NO:114) | 835 | 1008 |

TABLE 17-continued

Segment location on transcripts

| Transcript name | Segment starting position | Segment ending position |
|---|---|---|
| R11723_PEA_1_T6 (SEQ ID NO:115) | 869 | 1042 |

Segment cluster R11723_PEA_1_node_2 (SEQ ID NO: 119) according to the present invention is supported by 29 libraries. The number of libraries was determined as previously described. This segment can be found in the following transcript(s): R11723_PEA_1_T15 (SEQ ID NO: 110), R11723_PEA_1_T17 (SEQ ID NO: 111), R11723_PEA_1_T19 (SEQ ID NO: 112), R11723_PEA_1_T20 (SEQ ID NO: 113), R11723_PEA_1_T5 (SEQ ID NO: 114) and R11723_PEA_1_T6 (SEQ ID NO: 115). Table 18 below describes the starting and ending position of this segment on each transcript.

TABLE 18

Segment location on transcripts

| Transcript name | Segment starting position | Segment ending position |
|---|---|---|
| R11723_PEA_1_T15 (SEQ ID NO:110) | 1 | 309 |
| R11723_PEA_1_T17 (SEQ ID NO:111) | 1 | 309 |
| R11723_PEA_1_T19 (SEQ ID NO:112) | 1 | 309 |
| R11723_PEA_1_T20 (SEQ ID NO:113) | 1 | 309 |
| R11723_PEA_1_T5 (SEQ ID NO:114) | 1 | 309 |
| R11723_PEA_1_T6 (SEQ ID NO:115) | 1 | 309 |

Segment cluster R11723_PEA_1_node_22 (SEQ ID NO: 120) according to the present invention is supported by 65 libraries. The number of libraries was determined as previously described. This segment can be found in the following transcript(s): R11723_PEA_1_T5 (SEQ ID NO: 114) and R11723_PEA_1_T6 (SEQ ID NO: 115). Table 19 below describes the starting and ending position of this segment on each transcript.

TABLE 19

Segment location on transcripts

| Transcript name | Segment starting position | Segment ending position |
|---|---|---|
| R11723_PEA_1_T5 (SEQ ID NO:114) | 1083 | 1569 |
| R11723_PEA_1_T6 (SEQ ID NO:115) | 1117 | 1603 |

Segment cluster R11723_PEA_1_node_31 (SEQ ID NO: 121) according to the present invention is supported by 70 libraries. The number of libraries was determined as previously described. This segment can be found in the following transcript(s): R11723_PEA_1_T15 (SEQ ID NO: 110), R11723_PEA_1_T5 (SEQ ID NO: 114) and R11723_PEA_1_T6 (SEQ ID NO: 115). Table 20 below describes the starting and ending position of this segment on each transcript (it should be noted that these transcripts show alternative polyadenylation).

TABLE 20

Segment location on transcripts

| Transcript name | Segment starting position | Segment ending position |
|---|---|---|
| R11723_PEA_1_T15 (SEQ ID NO:110) | 1060 | 1295 |
| R11723_PEA_1_T5 (SEQ ID NO:114) | 1978 | 2213 |
| R11723_PEA_1_T6 (SEQ ID NO:115) | 2012 | 2247 |

According to an optional embodiment of the present invention, short segments related to the above cluster are also provided. These segments are up to about 120 bp in length, and so are included in a separate description.

Segment cluster R11723_PEA_1_node_10 (SEQ ID NO. 122) according to the present invention is supported by 38 libraries. The number of libraries was determined as previously described. This segment can be found in the following transcript(s): R11723_PEA_1_T15 (SEQ ID NO: 110), R11723_PEA_1_T17 (SEQ ID NO: 111), R11723_PEA_1_T19 (SEQ ID NO: 112), R11723_PEA_1_T20 (SEQ ID NO: 113), R11723_PEA_1_T5 (SEQ ID NO: 114) and R11723_PEA_1_T6 (SEQ ID NO: 115). Table 21 below describes the starting and ending position of this segment on each transcript.

TABLE 21

Segment location on transcripts

| Transcript name | Segment starting position | Segment ending position |
|---|---|---|
| R11723_PEA_1_T15 (SEQ ID NO:110) | 486 | 529 |
| R11723_PEA_1_T17 (SEQ ID NO:111) | 486 | 529 |
| R11723_PEA_1_T19 (SEQ ID NO:112) | 486 | 529 |
| R11723_PEA_1_T20 (SEQ ID NO:113) | 486 | 529 |
| R11723_PEA_1_T5 (SEQ ID NO:114) | 486 | 529 |
| R11723_PEA_1_T6 (SEQ ID NO:115) | 520 | 563 |

Segment cluster R11723_PEA_1_node_11 (SEQ ID NO: 123) according to the present invention is supported by 42 libraries. The number of libraries was determined as previously described. This segment can be found in the following transcript(s): R11723_PEA_1_T15 (SEQ ID NO: 110), R11723_PEA_1_T17 (SEQ ID NO: 111), R11723_PEA_1_T19 (SEQ ID NO: 112), R11723_PEA_1_T20 (SEQ ID NO: 113), R11723_PEA_1_T5 (SEQ ID NO: 114) and R11723_PEA_1_T6 (SEQ ID NO: 115). Table 22 below describes the starting and ending position of this segment on each transcript.

TABLE 22

Segment location on transcripts

| Transcript name | Segment starting position | Segment ending position |
|---|---|---|
| R11723_PEA_1_T15 (SEQ ID NO:110) | 530 | 623 |
| R11723_PEA_1_T17 (SEQ ID NO:111) | 530 | 623 |
| R11723_PEA_1_T19 (SEQ ID NO:112) | 530 | 623 |
| R11723_PEA_1_T20 (SEQ ID NO:113) | 530 | 623 |
| R11723_PEA_1_T5 (SEQ ID NO:114) | 530 | 623 |
| R11723_PEA_1_T6 (SEQ ID NO:115) | 564 | 657 |

Segment cluster R11723_PEA_1_node_15 (SEQ ID NO: 124) according to the present invention can be found in the following transcript(s): R11723_PEA_1_T20 (SEQ ID NO: 113). Table 23 below describes the starting and ending position of this segment on each transcript.

TABLE 23

Segment location on transcripts

| Transcript name | Segment starting position | Segment ending position |
|---|---|---|
| R11723_PEA_1_T20 (SEQ ID NO:113) | 624 | 627 |

Segment cluster R11723_PEA_1_node_18 (SEQ ID NO: 125) according to the present invention is supported by 40 libraries. The number of libraries was determined as previously described. This segment can be found in the following transcript(s): R11723_PEA_1_T15 (SEQ ID NO: 110), R11723_PEA_1_T5 (SEQ ID NO: 114) and R11723_PEA_1_T6 (SEQ ID NO: 115). Table 24 below describes the starting and ending position of this segment on each transcript.

TABLE 24

Segment location on transcripts

| Transcript name | Segment starting position | Segment ending position |
|---|---|---|
| R11723_PEA_1_T15 (SEQ ID NO:110) | 624 | 681 |
| R11723_PEA_1_T5 (SEQ ID NO:114) | 777 | 834 |
| R11723_PEA_1_T6 (SEQ ID NO:115) | 811 | 868 |

Segment cluster R11723_PEA_1_node_20 (SEQ ID NO: 126) according to the present invention can be found in the following transcript(s): R11723_PEA_1_T5 (SEQ ID NO: 114) and R11723_PEA_1_T6 (SEQ ID NO: 115). Table 25 below describes the starting and ending position of this segment on each transcript.

TABLE 25

Segment location on transcripts

| Transcript name | Segment starting position | Segment ending position |
|---|---|---|
| R11723_PEA_1_T5 (SEQ ID NO:114) | 1009 | 1019 |
| R11723_PEA_1_T6 (SEQ ID NO:115) | 1043 | 1053 |

Segment cluster R11723_PEA_1_node_21 (SEQ ID NO: 127) according to the present invention is supported by 36 libraries. The number of libraries was determined as previously described. This segment can be found in the following transcript(s): R11723_PEA_1_T5 (SEQ ID NO: 114) and R11723_PEA_1_T6 (SEQ ID NO: 115). Table 26 below describes the starting and ending position of this segment on each transcript.

TABLE 26

Segment location on transcripts

| Transcript name | Segment starting position | Segment ending position |
|---|---|---|
| R11723_PEA_1_T5 (SEQ ID NO:114) | 1020 | 1082 |
| R11723_PEA_1_T6 (SEQ ID NO:115) | 1054 | 1116 |

Segment cluster R11723_PEA_1_node_23 (SEQ ID NO: 128) according to the present invention is supported by 39 libraries. The number of libraries was determined as previously described. This segment can be found in the following transcript(s): R11723_PEA_1_T5 (SEQ ID NO: 114) and R11723_PEA_1_T6 (SEQ ID NO: 115). Table 27 below describes the starting and ending position of this segment on each transcript.

TABLE 27

Segment location on transcripts

| Transcript name | Segment starting position | Segment ending position |
|---|---|---|
| R11723_PEA_1_T5 (SEQ ID NO:114) | 1570 | 1599 |
| R11723_PEA_1_T6 (SEQ ID NO:115) | 1604 | 1633 |

Segment cluster R11723_PEA_1_node_24 (SEQ ID NO: 129) according to the present invention is supported by 51 libraries. The number of libraries was determined as previously described. This segment can be found in the following transcript(s): R11723_PEA_1_T15 (SEQ ID NO: 110), R11723_PEA_1_T5 (SEQ ID NO: 114) and R11723_PEA_1_T6 (SEQ ID NO: 115). Table 28 below describes the starting and ending position of this segment on each transcript.

TABLE 28

Segment location on transcripts

| Transcript name | Segment starting position | Segment ending position |
|---|---|---|
| R11723_PEA_1_T15 (SEQ ID NO:110) | 682 | 765 |
| R11723_PEA_1_T5 (SEQ ID NO:114) | 1600 | 1683 |
| R11723_PEA_1_T6 (SEQ ID NO:115) | 1634 | 1717 |

Segment cluster R11723_PEA_1_node_25 (SEQ ID NO: 130) according to the present invention is supported by 54 libraries. The number of libraries was determined as previously described. This segment can be found in the following transcript(s): R11723_PEA_1_T15 (SEQ ID NO: 110), R11723_PEA_1_T5 (SEQ ID NO: 114) and R11723_PEA_1_T6 (SEQ ID NO: 115). Table 29 below describes the starting and ending position of this segment on each transcript.

TABLE 29

Segment location on transcripts

| Transcript name | Segment starting position | Segment ending position |
|---|---|---|
| R11723_PEA_1_T15 (SEQ ID NO:110) | 766 | 791 |
| R11723_PEA_1_T5 (SEQ ID NO:114) | 1684 | 1709 |
| R11723_PEA_1_T6 (SEQ ID NO:115) | 1718 | 1743 |

Segment cluster R11723_PEA_1_node_26 (SEQ ID NO: 131) according to the present invention is supported by 62 libraries. The number of libraries was determined as previously described. This segment can be found in the following transcript(s): R11723_PEA_1_T15 (SEQ ID NO: 110), R11723_PEA_1_T5 (SEQ ID NO: 114) and R11723_PEA_1_T6 (SEQ ID NO: 115). Table 30 below describes the starting and ending position of this segment on each transcript.

TABLE 30

Segment location on transcripts

| Transcript name | Segment starting position | Segment ending position |
|---|---|---|
| R11723_PEA_1_T15 (SEQ ID NO:110) | 792 | 904 |
| R11723_PEA_1_T5 (SEQ ID NO:114) | 1710 | 1822 |
| R11723_PEA_1_T6 (SEQ ID NO:115) | 1744 | 1856 |

Segment cluster R11723_PEA_1_node_27 (SEQ ID NO: 132) according to the present invention is supported by 67 libraries. The number of libraries was determined as previously described. This segment can be found in the following transcript(s): R11723_PEA_1_T15 (SEQ ID NO: 110), R11723_PEA_1_T5 (SEQ ID NO: 114) and R11723_PEA_1_T6 (SEQ ID NO: 115). Table 31 below describes the starting and ending position of this segment on each transcript.

TABLE 31

Segment location on transcripts

| Transcript name | Segment starting position | Segment ending position |
|---|---|---|
| R11723_PEA_1_T15 (SEQ ID NO:110) | 905 | 986 |
| R11723_PEA_1_T5 (SEQ ID NO:114) | 1823 | 1904 |
| R11723_PEA_1_T6 (SEQ ID NO:115) | 1857 | 1938 |

Segment cluster R11723_PEA_1_node_28 (SEQ ID NO: 133) according to the present invention can be found in the following transcript(s): R11723_PEA_1_T15 (SEQ ID NO: 110), R11723_PEA_1_T5 (SEQ ID NO: 114) and R11723_PEA_1_T6 (SEQ ID NO: 115). Table 32 below describes the starting and ending position of this segment on each transcript.

TABLE 32

Segment location on transcripts

| Transcript name | Segment starting position | Segment ending position |
|---|---|---|
| R11723_PEA_1_T15 (SEQ ID NO:110) | 987 | 1010 |
| R11723_PEA_1_T5 (SEQ ID NO:114) | 1905 | 1928 |
| R11723_PEA_1_T6 (SEQ ID NO:115) | 1939 | 1962 |

Segment cluster R11723_PEA_1_node_29 (SEQ ID NO: 134) according to the present invention is supported by 69 libraries. The number of libraries was determined as previously described. This segment can be found in the following transcript(s): R11723_PEA_1_T15 (SEQ ID NO: 110), R11723_PEA_1_T5 (SEQ ID NO: 114) and R11723_PEA_1_T6 (SEQ ID NO: 115). Table 33 below describes the starting and ending position of this segment on each transcript.

TABLE 33

Segment location on transcripts

| Transcript name | Segment starting position | Segment ending position |
|---|---|---|
| R11723_PEA_1_T15 (SEQ ID NO:110) | 1011 | 1038 |
| R11723_PEA_1_T5 (SEQ ID NO:114) | 1929 | 1956 |
| R11723_PEA_1_T6 (SEQ ID NO:115) | 1963 | 1990 |

Segment cluster R11723_PEA_1_node_3 (SEQ ID NO: 135) according to the present invention can be found in the following transcript(s): R11723_PEA_1_T15 (SEQ ID NO: 110), R11723_PEA_1_T17 (SEQ ID NO: 111), R11723_PEA_1_T19 (SEQ ID NO: 112), R11723_PEA_1_T20 (SEQ ID NO: 113), R11723_PEA_1_T5 (SEQ ID NO: 114) and R11723_PEA_1_T6 (SEQ ID NO: 115). Table 34 below describes the starting and ending position of this segment on each transcript.

TABLE 34

Segment location on transcripts

| Transcript name | Segment starting position | Segment ending position |
|---|---|---|
| R11723_PEA_1_T15 (SEQ ID NO:110) | 310 | 319 |
| R11723_PEA_1_T17 (SEQ ID NO:111) | 310 | 319 |
| R11723_PEA_1_T19 (SEQ ID NO:112) | 310 | 319 |
| R11723_PEA_1_T20 (SEQ ID NO:113) | 310 | 319 |
| R11723_PEA_1_T5 (SEQ ID NO:114) | 310 | 319 |
| R11723_PEA_1_T6 (SEQ ID NO:115) | 310 | 319 |

Segment cluster R11723_PEA_1_node_30 (SEQ ID NO: 136) according to the present invention can be found in the following transcript(s): R11723_PEA_1_T15 (SEQ ID NO: 110), R11723_PEA_1_T5 (SEQ ID NO: 114) and R11723_PEA_1_T6 (SEQ ID NO: 115). Table 35 below describes the starting and ending position of this segment on each transcript.

TABLE 35

Segment location on transcripts

| Transcript name | Segment starting position | Segment ending position |
|---|---|---|
| R11723_PEA_1_T15 (SEQ ID NO:110) | 1039 | 1059 |
| R11723_PEA_1_T5 (SEQ ID NO:114) | 1957 | 1977 |
| R11723_PEA_1_T6 (SEQ ID NO:115) | 1991 | 2011 |

Segment cluster R11723_PEA_1_node_4 (SEQ ID NO: 137) according to the present invention is supported by 25 libraries. The number of libraries was determined as previously described. This segment can be found in the following transcript(s): R11723_PEA_1_T15 (SEQ ID NO: 110), R11723_PEA_1_T17 (SEQ ID NO: 111), R11723_PEA_1_T19 (SEQ ID NO: 112), R11723_PEA_1_T20 (SEQ ID NO: 113), R11723_PEA_1_T5 (SEQ ID NO: 114) and R11723_PEA_1_T6 (SEQ ID NO: 115). Table 36 below describes the starting and ending position of this segment on each transcript.

TABLE 36

Segment location on transcripts

| Transcript name | Segment starting position | Segment ending position |
|---|---|---|
| R11723_PEA_1_T15 (SEQ ID NO:110) | 320 | 371 |
| R11723_PEA_1_T17 (SEQ ID NO:111) | 320 | 371 |
| R11723_PEA_1_T19 (SEQ ID NO:112) | 320 | 371 |
| R11723_PEA_1_T20 (SEQ ID NO:113) | 320 | 371 |
| R11723_PEA_1_T5 (SEQ ID NO:114) | 320 | 371 |
| R11723_PEA_1_T6 (SEQ ID NO:115) | 320 | 371 |

Segment cluster R11723_PEA_1_node_5 (SEQ ID NO: 138) according to the present invention is supported by 26 libraries. The number of libraries was determined as previously described. This segment can be found in the following transcript(s): R11723_PEA_1_T15 (SEQ ID NO: 110), R11723_PEA_1_T17 (SEQ ID NO: 111), R11723_PEA_1_T19 (SEQ ID NO: 112), R11723_PEA_1_T20 (SEQ ID NO: 113), R11723_PEA_1_T5 (SEQ ID NO: 114) and R11723_PEA_1_T6 (SEQ ID NO: 115). Table 37 below describes the starting and ending position of this segment on each transcript.

TABLE 37

Segment location on transcripts

| Transcript name | Segment starting position | Segment ending position |
|---|---|---|
| R11723_PEA_1_T15 (SEQ ID NO:110) | 372 | 414 |
| R11723_PEA_1_T17 (SEQ ID NO:111) | 372 | 414 |
| R11723_PEA_1_T19 (SEQ ID NO:112) | 372 | 414 |
| R11723_PEA_1_T20 (SEQ ID NO:113) | 372 | 414 |
| R11723_PEA_1_T5 (SEQ ID NO:114) | 372 | 414 |
| R11723_PEA_1_T6 (SEQ ID NO:115) | 372 | 414 |

Segment cluster R11723_PEA_1_node_6 (SEQ ID NO: 139) according to the present invention is supported by 27 libraries. The number of libraries was determined as previously described. This segment can be found in the following transcript(s): R11723_PEA_1_T15 (SEQ ID NO: 110), R11723_PEA_1_T17 (SEQ ID NO: 111), R11723_PEA_1_T19 (SEQ ID NO: 112), R11723_PEA_1_T20 (SEQ ID NO: 113), R11723_PEA_1_T5 (SEQ ID NO: 114) and R11723_PEA_1_T6 (SEQ ID NO: 115). Table 38 below describes the starting and ending position of this segment on each transcript.

TABLE 38

Segment location on transcripts

| Transcript name | Segment starting position | Segment ending position |
|---|---|---|
| R11723_PEA_1_T15 (SEQ ID NO:110) | 415 | 446 |
| R11723_PEA_1_T17 (SEQ ID NO:111) | 415 | 446 |
| R11723_PEA_1_T19 (SEQ ID NO:112) | 415 | 446 |
| R11723_PEA_1_T20 (SEQ ID NO:113) | 415 | 446 |
| R11723_PEA_1_T5 (SEQ ID NO:114) | 415 | 446 |
| R11723_PEA_1_T6 (SEQ ID NO:115) | 415 | 446 |

Segment cluster R11723_PEA_1_node_7 (SEQ ID NO: 140) according to the present invention is supported by 29 libraries. The number of libraries was determined as previously described. This segment can be found in the following transcript(s): R11723_PEA_1_T15 (SEQ ID NO: 110), R11723_PEA_1_T17 (SEQ ID NO: 111), R11723_PEA_1_T19 (SEQ ID NO: 112), R11723_PEA_1_T20 (SEQ ID NO: 113), R11723_PEA_1_T5 (SEQ ID NO: 114) and R11723_PEA_1_T6 (SEQ ID NO: 115). Table 39 below describes the starting and ending position of this segment on each transcript.

TABLE 39

Segment location on transcripts

| Transcript name | Segment starting position | Segment ending position |
|---|---|---|
| R11723_PEA_1_T15 (SEQ ID NO:110) | 447 | 485 |
| R11723_PEA_1_T17 (SEQ ID NO:111) | 447 | 485 |
| R11723_PEA_1_T19 (SEQ ID NO:112) | 447 | 485 |
| R11723_PEA_1_T20 (SEQ ID NO:113) | 447 | 485 |
| R11723_PEA_1_T5 (SEQ ID NO:114) | 447 | 485 |
| R11723_PEA_1_T6 (SEQ ID NO:115) | 447 | 485 |

Segment cluster R11723_PEA_1_node_8 (SEQ ID NO: 141) according to the present invention is supported by 2 libraries. The number of libraries was determined as previously described. This segment can be found in the following transcript(s): R11723_PEA_1_T6 (SEQ ID NO: 115). Table 40 below describes the starting and ending position of this segment on each transcript.

TABLE 40

Segment location on transcripts

| Transcript name | Segment starting position | Segment ending position |
|---|---|---|
| R11723_PEA_1_T6 (SEQ ID NO:115) | 486 | 519 |

Variant protein alignment to the previously known protein:

Sequence name: /tmp/gp6eQTLWqk/mFtjUpUzhb:Q8IXM0 (SEQ ID NO: 968)

Sequence documentation:

Alignment of: R11723_PEA_1_P6 (SEQ ID NO: 143) x Q8IXM0 (SEQ ID NO: 968) . . .

Alignment segment 1/1:
  Quality: 1128.00
Escore: 0
  Matching length: 112 Total
length: 112
Matching Percent Similarity: 100.00 Matching Percent
Identity: 100.00
  Total Percent Similarity: 100.00 Total Percent
Identity: 100.00
  Gaps: 0
Alignment:

```
111 MYAQALLVVGVLQRQAAAQHLHEHPPKLLRGHRVQERVDDRAEVEKRLRE  160
    |||||||||||||||||||||||||||||||||||||||||||||||||
  1 MYAQALLVVGVLQRQAAAQHLHEHPPKLLRGHRVQERVDDRAEVEKRLRE   50

161 GEEDHVRPEVGPRPVVLGFGRSHDPPNLVGHPAYGQCHNNQPWADTSRRE  210
    |||||||||||||||||||||||||||||||||||||||||||||||||
 51 GEEDHVRPEVGPRPVVLGFGRSHDPPNLVGHPAYGQCHNNQPWADTSRRE  100

211 RQRKEKHSMRTQ                                        222
    ||||||||||||
101 RQRKEKHSMRTQ                                        112
```

Sequence name: /tmp/gp6eQTLWqk/mFtjUpUzhb:Q96AC2 (SEQ ID NO: 969)

Sequence documentation:

Alignment of: R11723_PEA_1_P6 (SEQ ID NO: 143) x Q96AC2 (SEQ ID NO: 969)...

Alignment segment 1/1:
  Quality: 835.00

Escore: 0
  Matching length: 83 Total length: 83

Matching Percent Similarity: 100.00 Matching Percent

Identity: 100.00
  Total Percent Similarity: 100.00 Total Percent

Identity: 100.00
  Gaps: 0

Alignment:

```
  1  MWVLGIAATFCGLFLLPGFALQIQCYQCEEFQLNNDCSSPEFIVNCTVNV  50
     |||||||||||||||||||||||||||||||||||||||||||||||||
  1  MWVLGIAATFCGLFLLPGFALQIQCYQCEEFQLNNDCSSPEFIVNCTVNV  50

51  QDMCQKEVMEQSAGIMYRKSCASSAACLIASAG  83
     |||||||||||||||||||||||||||||||||
 51  QDMCQKEVMEQSAGIMYRKSCASSAACLIASAG  83
```

Sequence name: /tmp/gp6eQTLWqk/mFtjUpUzhb:Q8N2G4 (SEQ ID NO: 970)

Alignment:

```
  1  MWVLGIAATFCGLFLLPGFALQIQCYQCEEFQLNNDCSSPEFIVNCTVNV  50
     |||||||||||||||||||||||||||||||||||||||||||||||||
  1  MWVLGIAATFCGLFLLPGFALQIQCYQCEEFQLNNDCSSPEFIVNCTVNV  50

51  QDMCQKEVMEQSAGIMYRKSCASSAACLIASAG  83
     |||||||||||||||||||||||||||||||||
 51  QDMCQKEVMEQSAGIMYRKSCASSAACLIASAG  83
```

Sequence documentation:

Alignment of: R11723_PEA_1_P6 (SEQ ID NO: 143) x Q8N2G4 (SEQ ID NO: 970)...

Alignment segment 1/1:
  Quality: 835.00

Escore: 0
  Matching length: 83 Total length: 83

Matching Percent Similarity: 100.00 Matching Percent

Identity: 100.00
  Total Percent Similarity: 100.00 Total Percent

Identity: 100.00
  Gaps: 0

Sequence name: /tmp/gp6eQTLWqk/mFtjUpUzhb:BAC85518 (SEQ ID NO: 971)

Sequence documentation:

Alignment of: R11723_PEA_1_P6 (SEQ ID NO: 143) x BAC85518 (SEQ ID NO: 971)...

Alignment segment 1/1:
  Quality: 835.00

Escore: 0
  Matching length: 83 Total length: 83

Matching Percent Similarity: 100.00 Matching Percent

Identity: 100.00

Total Percent Similarity: 100.00 Total Percent Identity: 100.00

Gaps: 0

Alignment:

```
 1  MWVLGIAATFCGLFLLPGFALQIQCYQCEEFQLNNDCSSPEFIVNCTVNV  50
    ||||||||||||||||||||||||||||||||||||||||||||||||||
24  MWVLGIAATFCGLFLLPGFALQIQCYQCEEFQLNNDCSSPEFIVNCTVNV  73

51  QDMCQKEVMEQSAGIMYRKSCASSAACLIASAG  83
    |||||||||||||||||||||||||||||||||
74  QDMCQKEVMEQSAGIMYRKSCASSAACLIASAG  106
```

Sequence name: /tmp/VXjdFlzdBX/bexTxTh0Th:Q96AC2 (SEQ ID NO: 969)

Sequence documentation:

Alignment of: R11723_PEA_1_P7 (SEQ ID NO: 144) x Q96AC2 (SEQ ID NO: 969) . . .

Alignment segment 1/1:

Quality: 654.00

Escore: 0

Matching length: 64 Total length: 64

Matching Percent Similarity: 100.00 Matching Percent Identity: 100.00

Total Percent Similarity: 100.00 Total Percent Identity: 100.00

Gaps: 0

Alignment:

```
 1  MWVLGIAATFCGLFLLPGFALQIQCYQCEEFQLNNDCSSPEFIVNCTVNV  50
    ||||||||||||||||||||||||||||||||||||||||||||||||||
 1  MWVLGIAATFCGLFLLPGFALQIQCYQCEEFQLNNDCSSPEFIVNCTVNV  50

51  QDMCQKEVMEQSAG  64
    ||||||||||||||
51  QDMCQKEVMEQSAG  64
```

Sequence name: /tmp/VXjdFlzdBX/bexTxTh0Th:BAC85273 (SEQ ID NO: 972)

Sequence documentation:

Alignment of: R11723_PEA_1_P7 (SEQ ID NO: 144) x BAC85273 (SEQ ID NO: 972) . . .

Alignment segment 1/1:

Quality: 600.00

Escore: 0

Matching length: 64 Total length: 64

Matching Percent Similarity: 100.00 Matching Percent Identity: 100.00

Total Percent Similarity: 100.00 Total Percent Identity: 100.00

Gaps: 0

Alignment:

```
 1  MWVLGIAATFCGLFLLPGFALQIQCYQCEEFQLNNDCSSPEFIVNCTVNV  50
    ||||||||||||||||||||||||||||||||||||||||||||||||||
 1  MWVLGIAATFCGLFLLPGFALQIQCYQCEEFQLNNDCSSPEFIVNCTVNV  50

51  QDMCQKEVMEQSAG  64
    ||||||||||||||
51  QDMCQKEVMEQSAG  64
```

Sequence name: /tmp/VXjdFlzdBX/bexTxTh0Th:Q8N2G4 (SEQ ID NO: 970)

Sequence documentation:

Alignment of: R11723_PEA_1_P7 (SEQ ID NO: 144) x Q8N2G4 (SEQ ID NO: 970) . . .

Alignment segment 1/1:

Quality: 654.00

Escore: 0

Matching length: 59 Total length: 59

Matching Percent Similarity: 100.00 Matching Percent Identity: 100.00

Total Percent Similarity: 100.00 Total Percent Identity: 100.00

Gaps: 0

Alignment:

```
  6  IAATFCGLFLLPGFALQIQCYQCEEFQLNNDCSSPEFIVNCTVNVQDMCQ  55
     ||||||||||||||||||||||||||||||||||||||||||||||||||
 22  IAATFCGLFLLPGFALQIQCYQCEEFQLNNDCSSPEFIVNCTVNVQDMCQ  71

56  KEVMEQSAG                                           64
     |||||||||
 72  KEVMEQSAG                                           80
```

Sequence name: /tmp/VXjdFlzdBX/bexTxTh0Th: BAC85518 (SEQ ID NO: 971)

Sequence documentation:

Alignment of: R11723_PEA_1_P7 (SEQ ID NO: 144) x BAC85518 (SEQ ID NO: 971)...

Alignment segment 1/1:
  Quality: 654.00

```
  1  MWVLGIAATFCGLFLLPGFALQIQCYQCEEFQLNNDCSSPEFIVNCTVNV  50
     ||||||||||||||||||||||||||||||||||||||||||||||||||
  1  MWVLGIAATFCGLFLLPGFALQIQCYQCEEFQLNNDCSSPEFIVNCTVNV  50

51  QDMCQKEVMEQSA                                        63
     |||||||||||||
 51  QDMCQKEVMEQSA                                        63
```

Escore: 0
  Matching length: 64 Total
length: 64
Matching Percent Similarity: 100.00 Matching Percent Identity: 100.00
  Total Percent Similarity: 100.00 Total Percent Identity: 100.00
  Gaps: 0
Alignment:

```
  1  MWVLGIAATFCGLFLLPGFALQIQCYQCEEFQLNNDCSSPEFIVNCTVNV  50
     ||||||||||||||||||||||||||||||||||||||||||||||||||
 24  MWVLGIAATFCGLFLLPGFALQIQCYQCEEFQLNNDCSSPEFIVNCTVNV  73

51  QDMCQKEVMEQSAG                                       64
     ||||||||||||||
 74  QDMCQKEVMEQSAG                                       87
```

Sequence name: /tmp/OLMSexEmIh/pc7Z7Xm1YR: Q96AC2 (SEQ ID NO: 969)

Sequence documentation:

Alignment of: R11723_PEA_1_P10 (SEQ ID NO: 146) x Q96AC2 (SEQ ID NO: 969)...

Alignment segment 1/1:
  Quality: 654.00

Escore: 0
  Matching length: 64 Total
length: 64

Matching Percent Similarity: 100.00 Matching Percent Identity: 100.00
  Total Percent Similarity: 100.00 Total Percent Identity: 100.00
  Gaps: 0
Alignment:

Sequence name: /tmp/OLMSexEmIh/pc7Z7Xm1YR: Q8N2G4 (SEQ ID NO: 970)

Sequence documentation:

Alignment of: R11723_PEA_1_P10 (SEQ ID NO: 146) x Q8N2G4 (SEQ ID NO: 970)...

Alignment segment 1/1:
  Quality: 645.00

Escore: 0
  Matching length: 63 Total
length: 63

Matching Percent Similarity: 100.00 Matching Percent Identity: 100.00
  Total Percent Similarity: 100.00 Total Percent Identity: 100.00
  Gaps: 0

Alignment:

```
  1  MWVLGIAATFCGLFLLPGFALQIQCYQCEEFQLNNDCSSPEFIVNCTVNV   50
     ||||||||||||||||||||||||||||||||||||||||||||||||||
  1  MWVLGIAATFCGLFLLPGFALQIQCYQCEEFQLNNDCSSPEFIVNCTVNV   50

51  QDMCQKEVMEQSA                                        63
     |||||||||||||
 51  QDMCQKEVMEQSA                                        63
```

Sequence name: /tmp/OLMSexEmIh/pc7Z7Xm1YR:BAC85273 (SEQ ID NO: 972)

Sequence documentation:

Alignment of: R11723_PEA_1_P10 (SEQ ID NO: 146) x BAC85273 (SEQ ID NO: 972) . . .

Alignment segment 1/1:
  Quality: 591.00

Escore: 0
  Matching length: 58 Total length: 58

Matching Percent Similarity: 100.00 Matching Percent Identity: 100.00
  Total Percent Similarity: 100.00 Total Percent Identity: 100.00
  Gaps: 0

Alignment:

Sequence name: /tmp/OLMSexEmIh/pc7Z7Xm1YR:BAC85518 (SEQ ID NO: 971)

Sequence documentation:

Alignment of: R11723_PEA_1_P10 (SEQ ID NO: 146) x BAC85518 (SEQ ID NO: 971) . . .

Alignment segment 1/1:
  Quality: 645.00

Escore: 0
  Matching length: 63 Total length: 63

Matching Percent Similarity: 100.00 Matching Percent Identity: 100.00
  Total Percent Similarity: 100.00 Total Percent Identity: 100.00
  Gaps: 0

Alignment:

```
  6  IAATFCGLFLLPGFALQIQCYQCEEFQLNNDCSSPEFIVNCTVNVQDMCQ   55
     ||||||||||||||||||||||||||||||||||||||||||||||||||
 22  IAATFCGLFLLPGFALQIQCYQCEEFQLNNDCSSPEFIVNCTVNVQDMCQ   71

56  KEVMEQSA                                             63
     ||||||||
 72  KEVMEQSA                                             79
```

```
  1  MWVLGIAATFCGLFLLPGFALQIQCYQCEEFQLNNDCSSPEFIVNCTVNV   50
     ||||||||||||||||||||||||||||||||||||||||||||||||||
 24  MWVLGIAATFCGLFLLPGFALQIQCYQCEEFQLNNDCSSPEFIVNCTVNV   73

51  QDMCQKEVMEQSAG                                       63
     |||||||||||||
 74  QDMCQKEVMEQSA                                        86
```

Alignment of: R11723_PEA__1_P13 (SEQ ID NO: 145) x Q96AC2 (SEQ ID NO: 969) . . .

Alignment segment 1/1:
Quality: 645.00

Escore: 0
Matching length: 63 Total length: 63

Matching Percent Similarity: 100.00 Matching Percent Identity: 100.00
Total Percent Similarity: 100.00 Total Percent Identity: 100.00
Gaps: 0

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
 1  MWVLGIAATFCGLFLLPGFALQIQCYQCEEFQLNNDCSSPEFIVNCTVNV  50

51  QDMCQKEVMEQSA  63
    |||||||||||||
51  QDMCQKEVMEQSA  63
```

Expression of R11723 transcripts which are detectable by amplicon as depicted in sequence R11723 seg13 (SEQ ID NO:975) in normal and cancerous ovary tissues Expression of transcripts detectable by or according to seg13, R11723seg13 amplicon(s) (SEQ ID NO:975) and R11723seg13F (SEQ ID NO:973) and R11723seg13R (SEQ ID NO:974) primers was measured by real time PCR. In parallel the expression of four housekeeping genes —PBGD (GenBank Accession No. BC019323, (SEQ ID NO:1036); amplicon—PBGD-amplicon, (SEQ ID NO:1039)), HPRT1 (GenBank Accession No. NM_000194, (SEQ ID NO:1040); amplicon—HPRT1-amplicon, (SEQ ID NO:1043)), SDHA (GenBank Accession No. NM_004168, (SEQ ID NO:1032); amplicon—SDHA-amplicon, (SEQ ID NO:1035)), and GAPDH (GenBank Accession No. BC026907, (SEQ ID NO:1044); GAPDH amplicon, (SEQ ID NO: 1047)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45-48, 71, Table 1, "Tissue samples in testing panel", above), to obtain a value of fold up-regulation for each sample relative to median of the normal PM samples.

Figure 16:
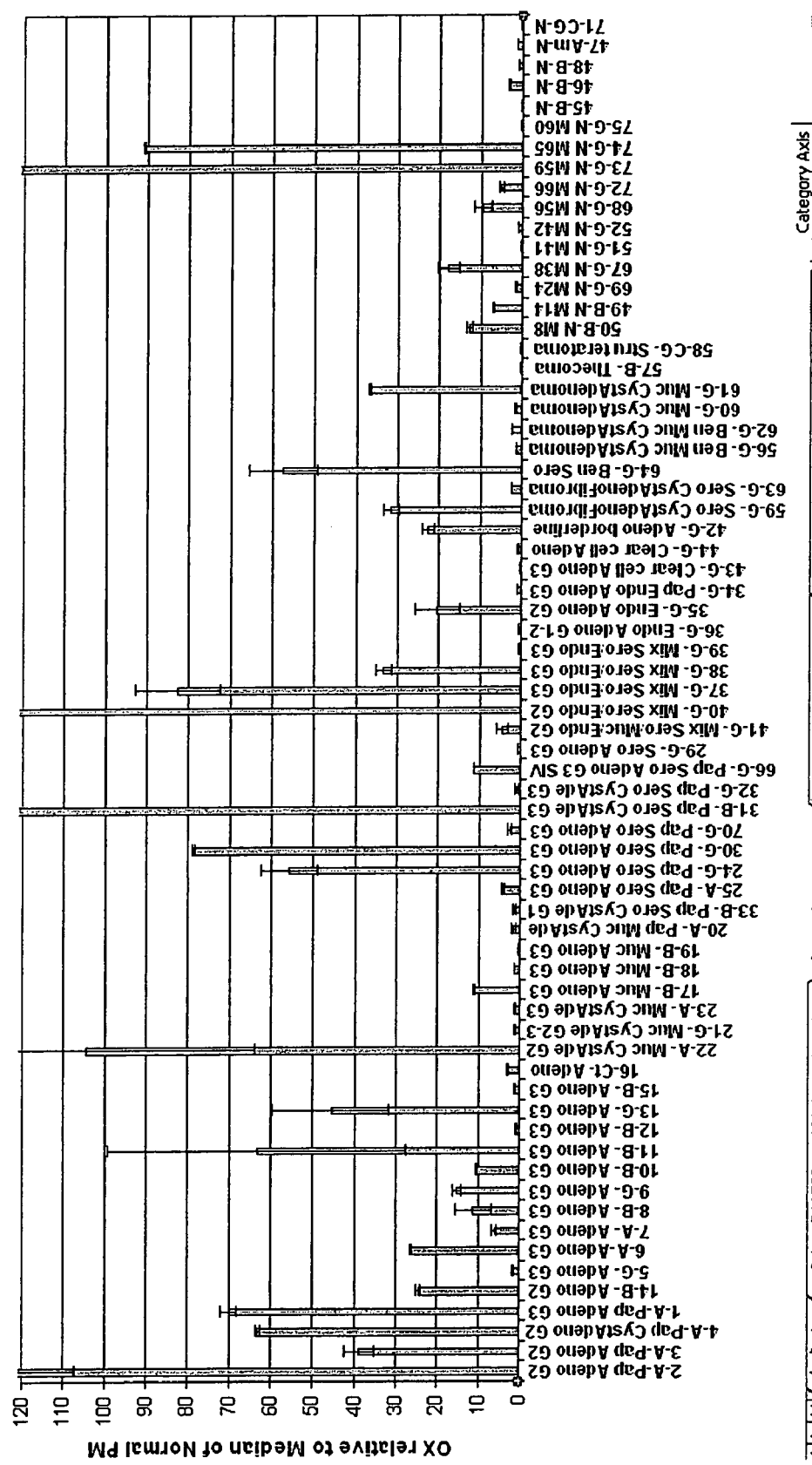
FIG. 16 is a histogram showing over expression of R11723 seg13 (SEQ ID NO:975) transcripts in cancerous ovary samples relative to the normal PM samples.

FIG. 16 is a histogram showing over expression of the above-indicated transcripts in cancerous ovary samples relative to the normal PM samples. Values represent the average of duplicate experiments. Error bars indicate the minimal and maximal values obtained.

As is evident from FIG. 16, the expression of transcripts detectable by the above amplicon(s) in cancer samples was significantly higher than in the non-cancerous samples (Sample Nos. 45-48, 71, Table 1, "Tissue samples in testing panel"). Notably an over-expression of at least 5 fold was found in 23 out of 43 adenocarcinoma samples, Statistical analysis was applied to verify the significance of these results, as described below.

The P value for the difference in the expression levels of transcripts detectable by the above amplicon(s) in ovary cancer samples versus the normal tissue samples was determined by T test as 4.76E-04.

Threshold of 5 fold overexpression was found to differentiate between cancer and normal samples with P value of 2.48E-02 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair R11723seg1F forward primer; and R11723seg13R (SEQ ID NO:974) reverse primer.

The present invention also preferably encompasses any amplicon obtained through the use of any suitable primer pair; for example, for the above experiment, the following amplicon was obtained as a non-limiting illustrative example only of a suitable amplicon: R11723seg13 (SEQ ID NO:975).

R11723seg13F (SEQ ID NO:973)—ACACTAAAAGAA-CAAACACCTTGCTC

R11723seg13R (SEQ ID NO:974)—TCCTCAGAAG-GCACATGAAAGA

R11723seg13 (SEQ ID NO:975)—ACACTAAAAGAA-CAAACACCTTGCTCTTCGAGATGAGA-CATTTTGCCAAGCAGTTG ACCACTTAGTTCTCAA-GAAGCAACTATCTCTTTCATGTGCCTTCTGAGGA Expression of R11723 transcripts which are detectable by amplicon as depicted in sequence name R11723seg13 (SEQ ID NO:975) in different normal tissues Expression of R11723 transcripts detectable by or according to R11723seg13 amplicon (SEQ ID NO:975) and R11723seg13F (SEQ ID NO:973), R11723seg13R (SEQ ID NO:974) was measured by real time PCR. In parallel the expression of four housekeeping genes RPL19 (GenBank Accession No. NM_000981, (SEQ ID NO:1048); RPL19 amplicon, (SEQ ID NO:1051)), TATA box (GenBank Accession No. NM_003194, (SEQ ID NO:1052); TATA amplicon, (SEQ ID NO:1055)), Ubiquitin (GenBank Accession No. BC000449, (SEQ ID NO: 1056); amplicon—Ubiquitin-amplicon, (SEQ ID NO: 1059)) and SDHA (GenBank Accession No. NM_004168, (SEQ ID NO: 1032); amplicon—SDHA-amplicon, (SEQ ID NO: 1035)) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 2 above, "Tissue samples in normal panel"), to obtain a value of relative expression of each sample relative to median of the ovary samples.

Figure 17:
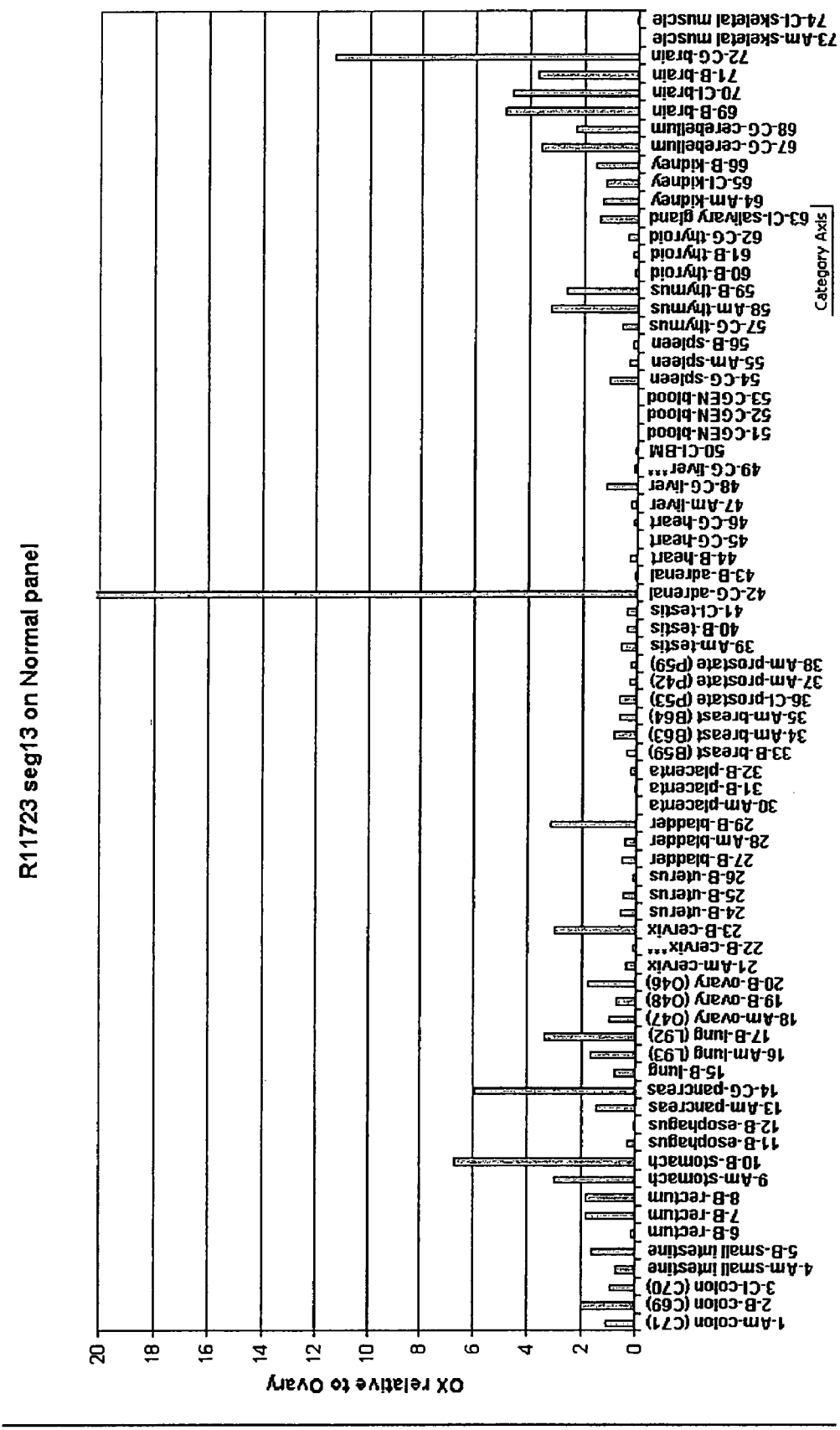
FIG. 17 is a histogram showing expression of R11723 seg13 (SEQ ID NO:975) transcripts in normal tissue samples.

The results are described in FIG. 17, presenting the histogram showing the expression of R11723 transcripts, which are detectable by amplicon as depicted in sequence name R11723seg13 (SEQ ID NO:975), in different normal tissues. Primers and amplicon are as above.

Expression of R11723 transcripts, which are detectable by amplicon as depicted in sequence R11723 junc11-18 (SEQ ID NO:978) in normal and cancerous ovary tissues Expression of transcripts detectable by or according to junc11-18 R11723 junc11-18 (SEQ ID NO:978) amplicon and R11723 junc11-18F (SEQ ID NO:976) and R1172 junc11-18R (SEQ ID NO:977) primers was measured by real time PCR (It should be noted that the variants of this cluster are variants of the hypothetical protein PSEC0181 (referred to herein as "PSEC"). Furthermore, use of the known protein (WT protein) for detection of ovarian cancer, alone or in combination with one or more variants of this cluster and/or of any other cluster and/or of any known marker, also comprises an embodiment of the present invention). In parallel the expression of four housekeeping genes —PBGD (GenBank Accession No. BC019323, (SEQ ID NO:1036); amplicon—PBGD-amplicon, (SEQ ID NO:1039)), HPRT1 (GenBank Accession No. NM_000194, (SEQ ID NO:1040); amplicon—HPRT1-amplicon, (SEQ ID NO:1043)), SDHA (GenBank Accession No. NM_004168, (SEQ ID NO:1032); amplicon—SDHA-amplicon, (SEQ ID NO:1035)), and GAPDH (GenBank Accession No. BC026907, (SEQ ID NO:1044); GAPDH amplicon, (SEQ ID NO: 1047)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos 45-48, 71, Table 1, above: "Tissue samples in ovarian cancer testing panel"), to obtain a value of fold up-regulation for each sample relative to median of the normal PM samples.

Figure 18:
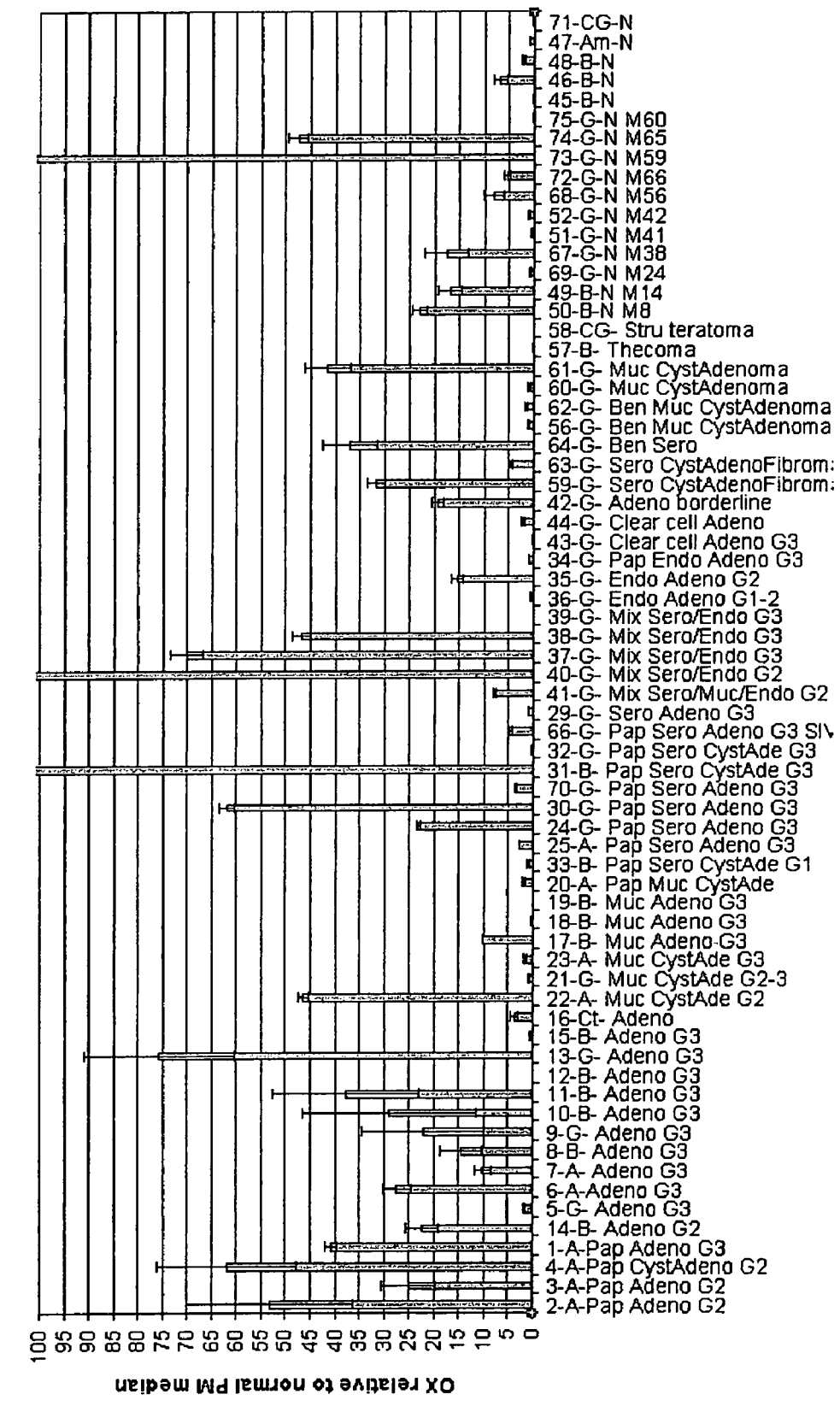
FIG. 18 is a histogram showing over expression of R11723 junc11-18 (SEQ ID NO:978) transcripts in cancerous ovary samples relative to the normal samples.

FIG. 18 is a histogram showing over expression of the above-indicated transcripts in cancerous ovary samples relative to the normal samples. Values represent the average of duplicate experiments. Error bars indicate the minimal and maximal values obtained.

As is evident from FIG. 18, the expression of transcripts detectable by the above amplicon in cancer samples was higher than in the non-cancerous samples (Sample Nos 45-48, 71 Table 1, "Tissue samples in ovarian cancer testing panel"). Notably an over-expression of at least 5 fold was found in 23 out of 43 adenocarcinoma samples.

Primer pairs are also optionally and preferably encompassed within the present invention; for example, for the above experiment, the following primer pair was used as a non-limiting illustrative example only of a suitable primer pair R11723 junc11-18F (SEQ ID NO:976) forward primer; and R11723 junc11-18R (SEQ ID NO:977) reverse primer.

The present invention also preferably encompasses any amplicon obtained through the use of any suitable primer pair; for example, for the above experiment, the following amplicon was obtained as a non-limiting illustrative example only of a suitable amplicon: R11723 junc11-18 (SEQ ID NO:978).

R11723junc11-18F (SEQ ID NO:976)—AGTGATG-GAGCAAAGTGCCG

R11723 junc11-18R (SEQ ID NO:977)—CAGCAGCT-GATGCAAACTGAG

R11723 junc11-18 (SEQ ID NO:978)—AGTGATGGAG-CAAAGTGCCGGGATCATGTACCG-CAAGTCCTGTGCATCATCAGCGG CCTGTCT-CATCGCCTCTGCCGGGTACCAGTCCTTCTGCTCCC CAGGGAAACTGAACT CAGTTTGCATCAGCTGCTG Expression of R11723 transcripts, which are detectable by amplicon as depicted in sequence name R11723 junc11-18 (SEQ ID NO:978) in different normal tissues Expression of R11723 transcripts detectable by or according to R11723seg13 (SEQ ID NO:978) amplicon and R11723 junc11-18F (SEQ ID NO:976), R11723 junc11-18R (SEQ ID NO:977) was measured by real time PCR. In parallel the expression of four housekeeping genes—RPL19 (GenBank Accession No. NM_000981, (SEQ ID NO:1048); RPL19 amplicon, (SEQ ID NO: 1051)), TATA box (GenBank Accession No. NM_003194, (SEQ ID NO: 1052); TATA amplicon, (SEQ ID NO:1055)), UBC (GenBank Accession No. BC000449, (SEQ ID NO: 1056); amplicon—Ubiquitin-amplicon, (SEQ ID NO: 1059)) and SDHA (GenBank Accession No. NM_004168, (SEQ ID NO:1032); amplicon—SDHA-amplicon, (SEQ ID NO: 1035)) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20 Table 2 above: "Tissue samples in normal panel"), to obtain a value of relative expression of each sample relative to median of the ovary samples.

Figure 19:
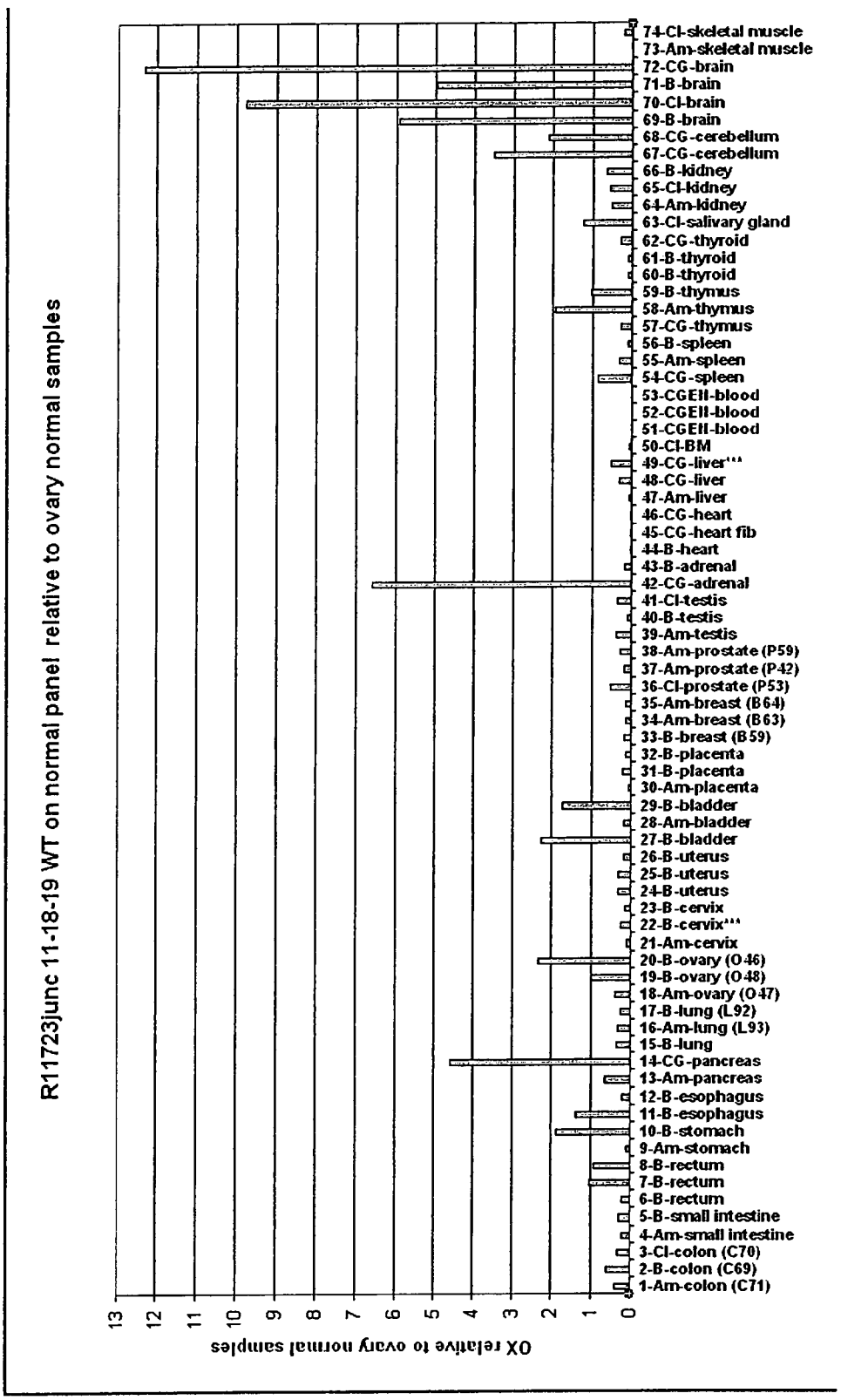
FIG. 19 is a histogram showing expression of R11723 junc11-18 (SEQ ID NO:978) transcripts in normal tissue samples.

The results are described in FIG. 19, presenting the histogram showing the expression of R11723 transcripts, which are detectable by amplicon as depicted in sequence name R11723 junc11-18 (SEQ ID NO:978), in different normal tissues. Amplicon and primers are as above.

DESCRIPTION FOR CLUSTER D56406

Cluster D56406 features 3 transcript(s) and 10 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| D56406_PEA_1_T3 | 147 |
| D56406_PEA_1_T6 | 148 |
| D56406_PEA_1_T7 | 149 |

TABLE 2

Segments of interest

| Segment Name | SEQ ID NO: |
|---|---|
| D56406_PEA_1_node_0 | 150 |
| D56406_PEA_1_node_13 | 151 |
| D56406_PEA_1_node_11 | 152 |
| D56406_PEA_1_node_2 | 153 |
| D56406_PEA_1_node_3 | 154 |
| D56406_PEA_1_node_5 | 155 |
| D56406_PEA_1_node_6 | 156 |
| D56406_PEA_1_node_7 | 157 |
| D56406_PEA_1_node_8 | 158 |
| D56406_PEA_1_node_9 | 159 |

TABLE 3

Proteins of interest

| Protein Name | SEQ ID NO: |
|---|---|
| D56406_PEA_1_P2 | 161 |
| D56406_PEA_1_P5 | 162 |
| D56406_PEA_1_P6 | 163 |

These sequences are variants of the known protein Neurotensin/neuromedin N precursor [Contains: Large neuromedin N (NmN-125); Neuromedin N (NmN) (NN); Neurotensin (NT); Tail peptide] (SwissProt accession identifier NEUT_HUMAN), SEQ ID NO: 160, referred to herein as the previously known protein.

Protein Neurotensin/neuromedin N precursor is known or believed to have the following function(s): Neurotensin may play an endocrine or paracrine role in the regulation of fat metabolism. It causes contraction of smooth muscle. The sequence for protein Neurotensin/neuromedin N precursor is given at the end of the application, as "Neurotensin/neuromedin N precursor [Contains: Large neuromedin N (NmN-125); Neuromedin N (NmN) (NN); Neurotensin (NT); Tail peptide] amino acid sequence". Protein Neurotensin/neuromedin N precursor localization is believed to be secreted; packaged within secretory vesicles.

The following GO Annotation(s) apply to the previously known protein. The following annotation(s) were found: signal transduction, which are annotation(s) related to Biological Process; neuropeptide hormone, which are annotation(s) related to Molecular Function; and extracellular; soluble fraction, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

As noted above, cluster D56406 features 3 transcript(s), which were listed in Table 1 above. These transcript(s) encode for protein(s) which are variant(s) of protein Neurotensin/neuromedin N precursor. A description of each variant protein according to the present invention is now provided.

Variant protein D56406_PEA_1_P2 (SEQ ID NO: 161) according to the present invention has an amino acid sequence as given at the end of the application; it is encoded by transcript(s) D56406_PEA_1_T3 (SEQ ID NO: 147). An alignment is given to the known protein (Neurotensin/neuromedin N precursor) at the end of the application. One or more alignments to one or more previously published protein sequences are given at the end of the application. A brief description of the relationship of the variant protein according to the present invention to each such aligned protein is as follows:

Comparison report between D56406_PEA_1_P2 (SEQ ID NO: 161) and NEUT_HUMAN:

1. An isolated chimeric polypeptide encoding for D56406_PEA_1_P2 (SEQ ID NO: 161), comprising a first amino acid sequence being at least 90% homologous to MMAGMKIQLVCMLLLAFSSWSLCSD-SEEEMKALEADFLTNMHTSKISKAHVPSWKMT LLNVCSLVNNLNSPAEETGEVHEEELVA-RRKLPTALDGFSLEAMLTIYQLHKICHSRAF QHWE corresponding to amino acids 1-120 of NEUT_HUMAN, which also corresponds to amino acids 1-120 of D56406_PEA_1_P2 (SEQ ID NO: 161), second amino acid sequence being at least 70%, optionally at least 80%, preferably at least 85%, more preferably at least 90% and most preferably at least 95% homologous to a polypeptide having the sequence ARWLTPVIPALWEAETGGSRGQEMETIPANT (SEQ ID NO: 1141) corresponding to amino acids 121-151 of D56406_PEA_1_P2 (SEQ ID NO: 161), and a third amino acid sequence being at least 90% homologous to LIQEDILDTGNDKNGKEEVIKRKIPY-ILKRQLYENKPRRPYILKRDSYYY corresponding to amino acids 121-170 of NEUT_HUMAN, which also corresponds to amino acids 152-201 of D56406_PEA_1_P2 (SEQ ID NO: 161), wherein said first, second and third amino acid sequences are contiguous and in a sequential order.

2. An isolated polypeptide encoding for an edge portion of D56406_PEA_1_P2 (SEQ ID NO: 161), comprising an amino acid sequence being at least 70%, optionally at least about 80%, preferably at least about 85%, more preferably at least about 90% and most preferably at least about 95% homologous to the sequence encoding for ARWLTPVIPALWEAETGGSRGQEMETIPANT (SEQ ID NO: 1141), corresponding to D56406_PEA_1_P2 (SEQ ID NO: 161).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein D56406_PEA_1_P2 (SEQ ID NO: 161) also has the following non-silent SNPs (Single Nucleotide Polymorphisms) as listed in Table 4, (given according to their position(s) on the amino acid sequence, with the alternative amino acid(s) listed; the last column indicates whether the SNP is known or not; the presence of known SNPs in variant protein D56406_PEA_1_P2 (SEQ ID NO: 161) sequence provides support for the deduced sequence of this variant protein according to the present invention).

TABLE 4

Amino acid mutations

| SNP position(s) on amino acid sequence | Alternative amino acid(s) | Previously known SNP? |
|---|---|---|
| 30 | M -> V | No |
| 44 | S -> P | No |
| 84 | V -> | No |
| 84 | V -> A | No |

Variant protein D56406_PEA_1_P2 (SEQ ID NO: 161) is encoded by the following transcript(s): D56406_PEA_1_T3 (SEQ ID NO: 147), for which the sequence(s) is/are given at the end of the application. The coding portion of transcript D56406_PEA_1_T3 (SEQ ID NO: 147) is shown in bold; this coding portion starts at position 106 and ends at position 708. The transcript also has the following SNPs as listed in Table 5 (given according to their position on the nucleotide sequence, with the alternative nucleic acid listed; the last column indicates whether the SNP is known or not; the presence of known SNPs in variant protein D56406_PEA_1_P2 (SEQ ID NO: 161) sequence provides support for the deduced sequence of this variant protein according to the present invention).

TABLE 5

Nucleic acid SNPs

| SNP position on nucleotide sequence | Alternative nucleic acid | Previously known SNP? |
|---|---|---|
| 94 | G -> T | No |
| 95 | A -> T | No |
| 858 | T -> G | Yes |
| 103 | A -> G | Yes |
| 193 | A -> G | No |
| 235 | T -> C | No |
| 339 | T -> C | No |
| 356 | T -> | No |
| 356 | T -> C | No |
| 417 | A -> T | No |
| 757 | T -> | No |

Variant protein D56406_PEA_1_P5 (SEQ ID NO: 162) according to the present invention has an amino acid sequence as given at the end of the application; it is encoded by transcript(s) D56406_PEA_1_T6 (SEQ ID NO: 148). An alignment is given to the known protein (Neurotensin/neuromedin N precursor) at the end of the application. One or more alignments to one or more previously published protein sequences are given at the end of the application. A brief description of the relationship of the variant protein according to the present invention to each such aligned protein is as follows:

Comparison report between D56406_PEA_1_P5 (SEQ ID NO: 162) and NEUT_HUMAN:

1. An isolated chimeric polypeptide encoding for D56406_PEA_1_P5 (SEQ ID NO: 162), comprising a first amino acid sequence being at least 90% homologous to MMAGMKIQLVCMLLLAFSSWSLC corresponding to amino acids 1-23 of NEUT_HUMAN, which also corresponds to amino acids 1-23 of D56406_PEA_1_P5 (SEQ ID NO: 162), and a second amino acid sequence being at least 90% homologous to SEEEMKALEADFLTNMHTSKIS-KAHVPSWKMTLLNVCSLVNNLNSPAEETGEVHEEEL VARRKLPTALDGFSLEAMLTIYQLH-KICHSRAFQHWELIQEDILDTGNDKNGKEEVIKR KIPYILKRQLYENKPRRPYILKRDSYYY corresponding to amino acids 26-170 of NEUT_HUMAN, which also corresponds to amino acids 24-168 of D56406_PEA_1_P5 (SEQ ID NO: 162), wherein said first and second amino acid sequences are contiguous and in a sequential order.

2. An isolated chimeric polypeptide encoding for an edge portion of D56406_PEA_1_P5 (SEQ ID NO: 162), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise CS, having a structure as follows: a sequence starting from any of amino acid numbers 23-x to 23; and ending at any of amino acid numbers 24+((n-2)-x), in which x varies from 0 to n-2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein D56406_PEA_1_P5 (SEQ ID NO: 162) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein D56406_PEA_1_P5 (SEQ ID NO: 162) sequence provides support for the deduced sequence of this variant protein according to the present invention).

TABLE 6

Amino acid mutations

| SNP position(s) on amino acid sequence | Alternative amino acid | Previously known SNP? |
|---|---|---|
| 28 | M -> V | No |
| 42 | S -> P | No |
| 82 | V -> | No |
| 82 | V -> A | No |

Variant protein D56406_PEA_1_P5 (SEQ ID NO: 162) is encoded by the following transcript(s): D56406_PEA_1_T6 (SEQ ID NO: 148), for which the sequence(s) is/are given at the end of the application. The coding portion of transcript D56406_PEA_1_T6 (SEQ ID NO: 148) is shown in bold; this coding portion starts at position 106 and ends at position 609. The transcript also has the following SNPs as listed in Table 7 (given according to their position on the nucleotide sequence, with the alternative nucleic acid listed; the last column indicates whether the SNP is known or not; the presence of known SNPs in variant protein D56406_PEA_1_P5 (SEQ ID NO: 162) sequence provides support for the deduced sequence of this variant protein according to the present invention).

TABLE 7

Nucleic acid SNPs

| SNP position on nucleotide sequence | Alternative nucleic acid | Previously known SNP? |
|---|---|---|
| 94 | G -> T | No |
| 95 | A -> T | No |
| 759 | T -> G | Yes |
| 806 | G -> A | Yes |
| 1014 | T -> G | No |
| 1178 | T -> G | No |
| 103 | A -> G | Yes |
| 187 | A -> G | No |
| 229 | T -> C | No |
| 333 | T -> C | No |
| 350 | T -> | No |
| 350 | T -> C | No |
| 411 | A -> T | No |
| 658 | T -> | No |

Variant protein D56406_PEA_1_P6 (SEQ ID NO: 163) according to the present invention has an amino acid sequence as given at the end of the application; it is encoded by transcript(s) D56406_PEA_1_T7 (SEQ ID NO: 149). An alignment is given to the known protein (Neurotensin/neuromedin N precursor) at the end of the application. One or more alignments to one or more previously published protein sequences are given at the end of the application. A brief description of the relationship of the variant protein according to the present invention to each such aligned protein is as follows:

Comparison report between D56406_PEA_1_P6 (SEQ ID NO: 163) and NEUT_HUMAN:

1. An isolated chimeric polypeptide encoding for D56406_PEA_1_P6 (SEQ ID NO: 163), comprising a first amino acid sequence being at least 90% homologous to MMAGMKIQLVCMLLLAFSSWSLCSD-SEEEMKALEADFLTNMHTSK corresponding to amino acids 1-45 of NEUT_HUMAN, which also corresponds to amino acids 1-45 of D56406_PEA_1_P6 (SEQ ID NO: 163), and a second amino acid sequence being at least 90% homologous to LIQEDILDTGNDKNGKEEVIKRKIPY-ILKRQLYENKPRRPYILKRDSYYY corresponding to amino acids 121-170 of NEUT_HUMAN, which also corresponds to amino acids 46-95 of D56406_PEA_1_P6 (SEQ ID NO: 163), wherein said first and second amino acid sequences are contiguous and in a sequential order.

2. An isolated chimeric polypeptide encoding for an edge portion of D56406_PEA_1_P6 (SEQ ID NO: 163), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KL, having a structure as follows: a sequence starting from any of amino acid numbers 45–x to 45; and ending at any of amino acid numbers 46+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein D56406_PEA_1_P6 (SEQ ID NO: 163) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein D56406_PEA_1_P6 (SEQ ID NO: 163) sequence provides support for the deduced sequence of this variant protein according to the present invention).

TABLE 8

Amino acid mutations

| SNP position(s) on amino acid sequence | Alternative amino acid(s) | Previously known SNP? |
|---|---|---|
| 30 | M -> V | No |
| 44 | S -> P | No |

Variant protein D56406_PEA_1_P6 (SEQ ID NO: 163) is encoded by the following transcript(s): D56406_PEA_1_T7 (SEQ ID NO: 149), for which the sequence(s) is/are given at the end of the application. The coding portion of transcript D56406_PEA_1_T7 (SEQ ID NO: 149) is shown in bold; this coding portion starts at position 106 and ends at position 390. The transcript also has the following SNPs as listed in Table 9 (given according to their position on the nucleotide sequence, with the alternative nucleic acid listed; the last column indicates whether the SNP is known or not; the presence of known SNPs in variant protein D56406_PEA_1_P6 (SEQ ID NO: 163) sequence provides support for the deduced sequence of this variant protein according to the present invention).

TABLE 9

Nucleic acid SNPs

| SNP position on nucleotide sequence | Alternative nucleic acid | Previously known SNP? |
|---|---|---|
| 94 | G -> T | No |
| 95 | A -> T | No |
| 103 | A -> G | Yes |
| 193 | A -> G | No |
| 235 | T -> C | No |
| 439 | T -> | No |
| 540 | T -> G | Yes |
| 587 | G -> A | Yes |
| 795 | T -> G | No |
| 959 | T -> G | No |

As noted above, cluster D56406 features 10 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster D56406_PEA_1_node_0 (SEQ ID NO: 150) according to the present invention is supported by 48 libraries. The number of libraries was determined as previously described. This segment can be found in the following transcript(s): D56406_PEA_1_T3 (SEQ ID NO: 147), D56406_PEA_1_T6 (SEQ ID NO: 148) and D56406_PEA_1_T7 (SEQ ID NO: 149). Table 10 below describes the starting and ending position of this segment on each transcript.

TABLE 10

Segment location on transcripts

| Transcript name | Segment starting position | Segment ending position |
|---|---|---|
| D56406_PEA_1_T3 (SEQ ID NO:147) | 1 | 178 |
| D56406_PEA_1_T6 (SEQ ID NO:148) | 1 | 178 |
| D56406_PEA_1_T7 (SEQ ID NO:149) | 1 | 178 |

Microarray (chip) data is also available for this segment as follows. As described above with regard to the cluster itself, various oligonucleotides were tested for being differentially expressed in various disease conditions, particularly cancer. The following oligonucleotides were found to hit this segment (with regard to ovarian cancer), shown in Table 11.

TABLE 11

Oligonucleotides related to this segment

| Oligonucleotide name | Overexpressed in cancers | Chip reference |
|---|---|---|
| D56406_0_5_0 (SEQ ID NO:1015) | ovarian carcinoma | OVA |

Segment cluster D56406_PEA_1_node_13 (SEQ ID NO: 151) according to the present invention is supported by 43 libraries. The number of libraries was determined as previously described. This segment can be found in the following transcript(s): D56406_PEA_1_T3 (SEQ ID NO: 147), D56406_PEA_1_T6 (SEQ ID NO: 148) and D56406_PEA_1_T7 (SEQ ID NO: 149). Table 12 below describes the starting and ending position of this segment on each transcript.

TABLE 12

Segment location on transcripts

| Transcript name | Segment starting position | Segment ending position |
|---|---|---|
| D56406_PEA_1_T3 (SEQ ID NO:147) | 559 | 902 |
| D56406_PEA_1_T6 (SEQ ID NO:148) | 460 | 1239 |
| D56406_PEA_1_T7 (SEQ ID NO:149) | 241 | 1020 |

According to an optional embodiment of the present invention, short segments related to the above cluster are also provided. These segments are up to about 120 bp in length, and so are included in a separate description.

Segment cluster D56406_PEA_1_node_11 (SEQ ID NO: 152) according to the present invention is supported by 1 libraries. The number of libraries was determined as previously described. This segment can be found in the following transcript(s): D56406_PEA_1_T3 (SEQ ID NO: 147). Table 13 below describes the starting and ending position of this segment on each transcript.

TABLE 13

Segment location on transcripts

| Transcript name | Segment starting position | Segment ending position |
|---|---|---|
| D56406_PEA_1_T3 (SEQ ID NO:147) | 466 | 558 |

Segment cluster D56406_PEA_1_node_2 (SEQ ID NO: 153) according to the present invention can be found in the following transcript(s): D56406_PEA_1_T3 (SEQ ID NO: 147) and D56406_PEA_1_T7 (SEQ ID NO: 149). Table 14 below describes the starting and ending position of this segment on each transcript.

TABLE 14

Segment location on transcripts

| Transcript name | Segment starting position | Segment ending position |
|---|---|---|
| D56406_PEA_1_T3 (SEQ ID NO:147) | 179 | 184 |
| D56406_PEA_1_T7 (SEQ ID NO:149) | 179 | 184 |

Segment cluster D56406_PEA_1_node_3 (SEQ ID NO: 154) according to the present invention is supported by 46 libraries. The number of libraries was determined as previously described. This segment can be found in the following transcript(s): D56406_PEA_1_T3 (SEQ ID NO: 147), D56406_PEA_1_T6 (SEQ ID NO: 148) and D56406_PEA_1_T7 (SEQ ID NO: 149). Table 15 below describes the starting and ending position of this segment on each transcript.

TABLE 15

Segment location on transcripts

| Transcript name | Segment starting position | Segment ending position |
|---|---|---|
| D56406_PEA_1_T3 (SEQ ID NO:147) | 185 | 240 |
| D56406_PEA_1_T6 (SEQ ID NO:148) | 179 | 234 |
| D56406_PEA_1_T7 (SEQ ID NO:149) | 185 | 240 |

Segment cluster D56406_PEA_1_node_5 (SEQ ID NO: 155) according to the present invention is supported by 48 libraries. The number of libraries was determined as previously described. This segment can be found in the following transcript(s): D56406_PEA_1_T3 (SEQ ID NO: 147) and D56406_PEA_1_T6 (SEQ ID NO: 148). Table 16 below describes the starting and ending position of this segment on each transcript.

TABLE 16

Segment location on transcripts

| Transcript name | Segment starting position | Segment ending position |
|---|---|---|
| D56406_PEA_1_T3 (SEQ ID NO:147) | 241 | 355 |
| D56406_PEA_1_T6 (SEQ ID NO:148) | 235 | 349 |

Segment cluster D56406_PEA_1_node_6 (SEQ ID NO: 156) according to the present invention is supported by 34 libraries. The number of libraries was determined as previously described. This segment can be found in the following transcript(s): D56406_PEA_1_T3 (SEQ ID NO: 147) and D56406_PEA_1_T6 (SEQ ID NO: 148). Table 17 below describes the starting and ending position of this segment on each transcript.

TABLE 17

Segment location on transcripts

| Transcript name | Segment starting position | Segment ending position |
|---|---|---|
| D56406_PEA_1_T3 (SEQ ID NO:147) | 356 | 389 |
| D56406_PEA_1_T6 (SEQ ID NO:148) | 350 | 383 |

Segment cluster D56406_PEA_1_node_7 (SEQ ID NO: 157) according to the present invention is supported by 32 libraries. The number of libraries was determined as previously described. This segment can be found in the following transcript(s): D56406_PEA_1_T3 (SEQ ID NO: 147) and D56406_PEA_1_T6 (SEQ ID NO: 148). Table 18 below describes the starting and ending position of this segment on each transcript.

TABLE 18

Segment location on transcripts

| Transcript name | Segment starting position | Segment ending position |
|---|---|---|
| D56406_PEA_1_T3 (SEQ ID NO:147) | 390 | 415 |
| D56406_PEA_1_T6 (SEQ ID NO:148) | 384 | 409 |

Segment cluster D56406_PEA_1_node_8 (SEQ ID NO: 158) according to the present invention can be found in the following transcript(s): D56406_PEA_1_T3 (SEQ ID NO: 147) and D56406_PEA_1_T6 (SEQ ID NO: 148). Table 19 below describes the starting and ending position of this segment on each transcript.

TABLE 19

Segment location on transcripts

| Transcript name | Segment starting position | Segment ending position |
|---|---|---|
| D56406_PEA_1_T3 (SEQ ID NO:147) | 416 | 423 |
| D56406_PEA_1_T6 (SEQ ID NO:148) | 410 | 417 |

TABLE 20

Segment location on transcripts

| Transcript name | Segment starting position | Segment ending position |
|---|---|---|
| D56406_PEA_1_T3 (SEQ ID NO:147) | 424 | 465 |
| D56406_PEA_1_T6 (SEQ ID NO:148) | 418 | 459 |

Variant protein alignment to the previously known protein:

Sequence name: /tmp/jU49325aMA/8F0XuN7La5:NEU-T_HUMAN

Sequence documentation:

Alignment of: D56406_PEA_1_P2 (SEQ ID NO: 161) x NEUT_HUMAN . . .

Alignment segment 1/1:
  Quality: 1591.00

Escore: 0
  Matching length: 170 Total
length: 201

Matching Percent Similarity: 100.00 Matching Percent Identity: 100.00
  Total Percent Similarity: 84.58 Total Percent Identity: 84.58
  Gaps: 1

Alignment:

```
  1  MMAGMKIQLVCMLLLAFSSWSLCSDSEEEMKALEADFLTNMHTSKISKAH   50
     ||||||||||||||||||||||||||||||||||||||||||||||||||
  1  MMAGMKIQLVCMLLLAFSSWSLCSDSEEEMKALEADFLTNMHTSKISKAH   50

51  VPSWKMTLLNVCSLVNNLNSPAEETGEVHEEELVARRKLPTALDGFSLEA  100
     ||||||||||||||||||||||||||||||||||||||||||||||||||
 51  VPSWKMTLLNVCSLVNNLNSPAEETGEVHEEELVARRKLPTALDGFSLEA  100

101  MLTIYQLHKICHSRAFQHWEARWLTPVIPALWEAETGGSRGQEMETIPAN  150
     ||||||||||||||||||
101  MLTIYQLHKICHSRAFQHWE.............................  120

151  TLIQEDILDTGNDKNGKEEVIKRKIPYILKRQLYENKPRRPYILKRDSYY  200
     |||||||||||||||||||||||||||||||||||||||||||||||||
121  .LIQEDILDTGNDKNGKEEVIKRKIPYILKRQLYENKPRRPYILKRDSYY  169
201  Y                                                 201
     |
170  Y                                                 170
```

Segment cluster D56406_PEA_1_node_9 (SEQ ID NO: 159) according to the present invention is supported by 31 libraries. The number of libraries was determined as previously described. This segment can be found in the following transcript(s): D56406_PEA_1_T3 (SEQ ID NO: 147) and D56406_PEA_1_T6 (SEQ ID NO: 148). Table 20 below describes the starting and ending position of this segment on each transcript.

Sequence name: /tmp/wWui8 Kd4y9/zbf31hRwnR:NEU-T_HUMAN

Sequence documentation:

Alignment of: D56406_PEA_1_P5 (SEQ ID NO: 162) x NEUT_HUMAN . . .

Alignment segment 1/1:
  Quality: 1572.00

Escore: 0
  Matching length: 168 Total
length: 170

Matching Percent Similarity: 100.00 Matching Percent

Identity: 100.00
  Total Percent Similarity: 98.82 Total Percent

Identity: 98.82
  Gaps: 1

Alignment:

```
  1 MMAGMKIQLVCMLLLAFSSWSLC..SEEEMKALEADFLTNMHTSKISKAH   48
    ||||||||||||||||||||||  |||||||||||||||||||||||||
  1 MMAGMKIQLVCMLLLAFSSWSLCSDSEEEMKALEADFLTNMHTSKISKAH   50

49 VPSWKMTLLNVCSLVNNLNSPAEETGEVHEEELVARRKLPTALDGFSLEA   98
    |||||||||||||||||||||||||||||||||||||||||||||||||
 51 VPSWKMTLLNVCSLVNNLNSPAEETGEVHEEELVARRKLPTALDGFSLEA  100

101 MLTIYQLHKICHSRAFQHWELIQEDILDTGNDKNGKEEVIKRKIPYILKR  148
    |||||||||||||||||||||||||||||||||||||||||||||||||
101 MLTIYQLHKICHSRAFQHWELIQEDILDTGNDKNGKEEVIKRKIPYILKR  150

149 QLYENKPRRPYILKRDSYYY                                168
    ||||||||||||||||||||
151 QLYENKPRRPYILKRDSYYY                                170
```

Sequence name: /tmp/f5d07fF5D7/E4N5xjUIAN:NEUT_HUMAN

Sequence documentation:

Alignment of: D56406_PEA_1_P6 (SEQ ID NO: 163) x NEUT_HUMAN ...

Alignment segment 1/1:
  Quality: 844.00

Escore: 0
  Matching length: 95 Total length: 170

Matching Percent Similarity: 100.00 Matching Percent

Identity: 100.00
  Total Percent Similarity: 55.88 Total Percent

Identity: 55.88
  Gaps: 1

Alignment:

```
  1 MMAGMKIQLVCMLLLAFSSWSLCSDSEEEMKALEADFLTNMHTSK.....   45
    ||||||||||||||||||||||||||||||||||||||||||||
  1 MMAGMKIQLVCMLLLAFSSWSLCSDSEEEMKALEADFLTNMHTSKISKAH   50

45 ..................................................   45

51 VPSWKMTLLNVCSLVNNLNSPAEETGEVHEEELVARRKLPTALDGFSLEA  100

46 ....................LIQEDILDTGNDKNGKEEVIKRKIPYILKR   75
                        ||||||||||||||||||||||||||||||
101 MLTIYQLHKICHSRAFQHWELIQEDILDTGNDKNGKEEVIKRKIPYILKR  150

76 QLYENKPRRPYILKRDSYYY                                95
    ||||||||||||||||||||
151 QLYENKPRRPYILKRDSYYY                               170
```

DESCRIPTION FOR CLUSTER H53393

Cluster H53393 features 4 transcript(s) and 16 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| H53393_PEA_1_T10 | 164 |
| H53393_PEA_1_T11 | 165 |
| H53393_PEA_1_T3 | 166 |
| H53393_PEA_1_T9 | 167 |

TABLE 2

Segments of interest

| Segment Name | SEQ ID NO: |
|---|---|
| H53393_PEA_1_node_0 | 168 |
| H53393_PEA_1_node_10 | 169 |
| H53393_PEA_1_node_12 | 170 |

TABLE 2-continued

Segments of interest

| Segment Name | SEQ ID NO: |
|---|---|
| H53393_PEA_1_node_13 | 171 |
| H53393_PEA_1_node_15 | 172 |
| H53393_PEA_1_node_17 | 173 |
| H53393_PEA_1_node_19 | 174 |
| H53393_PEA_1_node_23 | 175 |
| H53393_PEA_1_node_24 | 176 |
| H53393_PEA_1_node_25 | 177 |
| H53393_PEA_1_node_29 | 178 |
| H53393_PEA_1_node_4 | 179 |
| H53393_PEA_1_node_6 | 180 |
| H53393_PEA_1_node_8 | 181 |
| H53393_PEA_1_node_21 | 182 |
| H53393_PEA_1_node_22 | 183 |

TABLE 3

Proteins of interest

| Protein Name | SEQ ID NO: |
|---|---|
| H53393_PEA_1_P2 | 185 |
| H53393_PEA_1_P3 | 186 |
| H53393_PEA_1_P6 | 187 |

These sequences are variants of the known protein Cadherin-6 precursor (SwissProt accession identifier CAD6_HUMAN; known also according to the synonyms Kidney-cadherin; K-cadherin), SEQ ID NO: 184, referred to herein as the previously known protein.

Protein Cadherin-6 precursor is known or believed to have the following function(s): Cadherins are calcium dependent cell adhesion proteins. They preferentially interact with themselves in a homophilic manner in connecting cells; cadherins may thus contribute to the sorting of heterogeneous cell types. The sequence for protein Cadherin-6 precursor is given at the end of the application, as "Cadherin-6 precursor amino acid sequence". Known polymorphisms for this sequence are as shown in Table 4.

TABLE 4

Amino acid mutations for Known Protein

| SNP position(s) on amino acid sequence | Comment |
|---|---|
| 421 | V -> I |
| 425 | T -> I |

Protein Cadherin-6 precursor localization is believed to be Type I membrane protein.

The following GO Annotation(s) apply to the previously known protein. The following annotation(s) were found: cell adhesion; homophilic cell adhesion, which are annotation(s) related to Biological Process; calcium binding; protein binding, which are annotation(s) related to Molecular Function; and integral membrane protein, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster H53393 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 20 refer to weighted expression of ESTs in each category, as "parts per million" (ratio of the expression of ESTs for a particular cluster to the expression of all ESTs in that category, according to parts per million).

Figure 20:
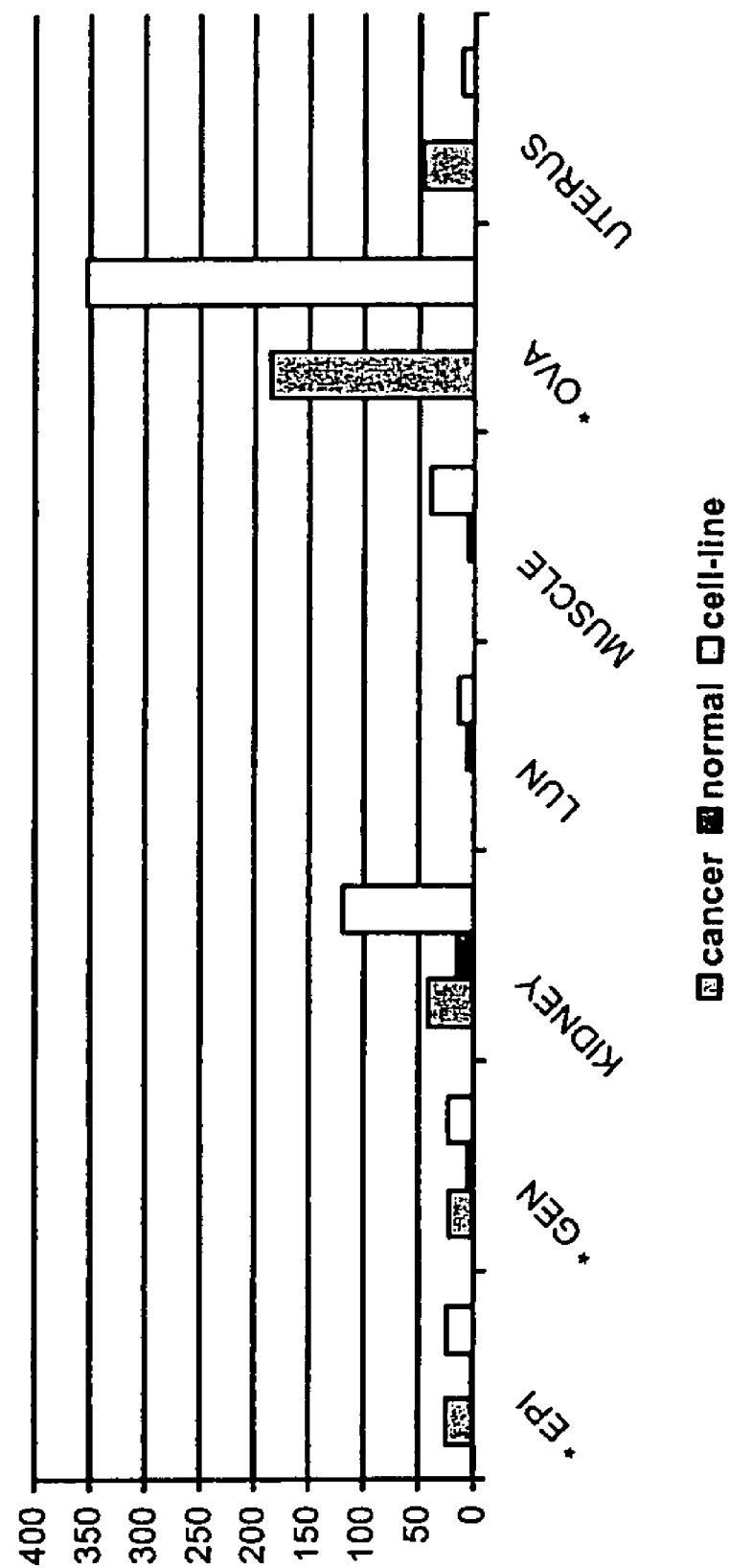
FIG. 20 shows cancer and cell-line vs. normal tissue expression.

Overall, the following results were obtained as shown with regard to the histograms in FIG. 20 and Table 5. This cluster is overexpressed (at least at a minimum level) in the following pathological conditions: epithelial malignant tumors, a mixture of malignant tumors from different tissues and ovarian carcinoma.

TABLE 5

Normal tissue distribution

| Name of Tissue | Number |
|---|---|
| epithelial | 2 |
| general | 5 |
| kidney | 15 |
| lung | 6 |
| muscle | 5 |
| ovary | 0 |
| uterus | 0 |

TABLE 6

P values and ratios for expression in cancerous tissue

| Name of Tissue | P1 | P2 | SP1 | R3 | SP2 | R4 |
|---|---|---|---|---|---|---|
| epithelial | 1.4e−01 | 1.1e−01 | 1.8e−04 | 6.3 | 2.5e−05 | 5.9 |
| general | 2.0e−01 | 8.6e−02 | 1.1e−04 | 3.1 | 1.3e−06 | 3.2 |
| kidney | 5.5e−01 | 4.4e−01 | 3.4e−01 | 1.7 | 8.2e−02 | 2.3 |
| lung | 9.5e−01 | 8.5e−01 | 1 | 0.6 | 6.2e−01 | 1.1 |
| muscle | 9.2e−01 | 4.8e−01 | 1 | 0.8 | 3.9e−01 | 2.0 |
| ovary | 7.1e−02 | 3.0e−02 | 1.5e−02 | 5.2 | 2.9e−03 | 5.9 |
| uterus | 8.2e−02 | 1.4e−01 | 1.9e−01 | 3.0 | 3.3e−01 | 2.2 |

As noted above, cluster H53393 features 4 transcript(s), which were listed in Table 1 above. These transcript(s) encode for protein(s) which are variant(s) of protein Cadherin-6 precursor. A description of each variant protein according to the present invention is now provided.

Variant protein H53393_PEA_1_P2 (SEQ ID NO: 185) according to the present invention has an amino acid sequence as given at the end of the application; it is encoded by transcript(s) H53393_PEA_1_T10 (SEQ ID NO: 164). An alignment is given to the known protein (Cadherin-6 precursor) at the end of the application. One or more alignments to one or more previously published protein sequences are given at the end of the application. A brief description of the relationship of the variant protein according to the present invention to each such aligned protein is as follows:

Comparison report between H53393_PEA_1_P2 (SEQ ID NO: 185) and CAD6_HUMAN:

1. An isolated chimeric polypeptide encoding for H53393_PEA_1_P2 (SEQ ID NO: 185), comprising a first amino acid sequence being at least 90% homologous to MRTYRYFLLLFWVGQPYPTLSTPL-SKRTSGFPAKKRALELSGNSKNELNRSKRSWMWN QFFLLEEYTGSDYQYVGKLHS-DQDRGDGSLKYILSGDGAGDLFIINENT-GDIQATKRLD REEKPVYILRAQAINRRTGRPVEPE-SEFIIKIHDINDNEPIFTKEVYTATVPEMSDVGTFVV QVTATDADDPTYGNSAKV-
VYSILQGQPYFSVESETGIIKTALLNM-
DRENREQYQVVIQA KDMGGQMGGLSGTTTVNITLT-
DVNDNPPRFPQSTYQFKTPESSPPGTPIGRIKASDADV
GENAEIEYSITDGEGLDMFDVIT-
DQETQEGIITVKKLLDFEKKKVYTLKVEASNPYVEPR
FLYLGPFKDSATVRIVVEDVDEPPVF-
SKLAYILQIREDAQINTTIGSVTAQDPDAARNPV KYS-
VDRHTDMDRIFNIDSGNGSIFTSKLL-
DRETLLWHNITVIATEINNPKQSSRVPLYIKV
LDVNDNAPEFAEFYET-
FVCEKAKADQLIQTLHAVDKDDPYS-
GHQFSFSLAPEAASGSNF TIQDNK corresponding to amino acids 1-543 of CAD6_HUMAN, which also corresponds to amino acids 1-543 of H53393_PEA_1_P2 (SEQ ID NO: 185), and a second amino acid sequence being at least 70%, optionally at least 80%, preferably at least 85%, more preferably at least 90% and most preferably at least 95% homologous to a polypeptide having the sequence GK corresponding to amino acids 544-545 of H53393_PEA_1_P2 (SEQ ID NO: 185), wherein said first and second amino acid sequences are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H53393_PEA_1_P2 (SEQ ID NO: 185) is encoded by the following transcript(s): H53393_PEA_1_T10 (SEQ ID NO: 164), for which the sequence(s) is/are given at the end of the application. The coding portion of transcript H53393_PEA_1_T10 (SEQ ID NO: 164) is shown in bold; this coding portion starts at position 327 and ends at position 1961. The transcript also has the following SNPs as listed in Table 7 (given according to their position on the nucleotide sequence, with the alternative nucleic acid listed; the last column indicates whether the SNP is known or not; the presence of known SNPs in variant protein H53393_PEA_1_P2 (SEQ ID NO: 185) sequence provides support for the deduced sequence of this variant protein according to the present invention).

TABLE 7

| SNP position on nucleotide sequence | Nucleic acid SNPs Alternative nucleic acid | Previously known SNP? |
|---|---|---|
| 1208 | C -> T | Yes |
| 1407 | T -> C | Yes |
| 1851 | T -> C | Yes |
| 1886 | G -> A | Yes |
| 2309 | C -> T | Yes |
| 2736 | T -> C | Yes |
| 2762 | G -> T | Yes |

Variant protein H53393_PEA_1_P3 (SEQ ID NO: 186) according to the present invention has an amino acid sequence as given at the end of the application; it is encoded by transcript(s) H53393_PEA_1_T11 (SEQ ID NO: 165) and H53393_PEA_1_T3 (SEQ ID NO: 166). An alignment is given to the known protein (Cadherin-6 precursor) at the end of the application. One or more alignments to one or more previously published protein sequences are given at the end of the application. A brief description of the relationship of the variant protein according to the present invention to each such aligned protein is as follows:

Comparison report between H53393_PEA_1_P3 (SEQ ID NO: 186) and CAD6_HUMAN:

1. An isolated chimeric polypeptide encoding for H53393_PEA_1_P3 (SEQ ID NO: 186), comprising a first amino acid sequence being at least 90% homologous to MRTYRYFLLLFWVGQPYPTLSTPL-
SKRTSGFPAKKRALELSGNSKNELNRSKRSWMWN
QFFLLEEYTGSDYQYVGKLHS-
DQDRGDGSLKYILSGDGAGDLFIINENT-
GDIQATKRLD REEKPVYILRAQAINRRTGRPVEPE-
SEFIIKIHDINDNEPIFTKEVYTATVPEMSDVGTFVV
QVTATDADDPTYGNSAKV-
VYSILQGQPYFSVESETGIIKTALLNM-
DRENREQYQVVIQA KDMGGQMGGLSGTTTVNITLT-
DVNDNPPRFPQSTYQFKTPESSPPGTPIGRIKASDADV
GENAEIEYSITDGEGLDMFDVIT-
DQETQEGIITVKKLLDFEKKKVYTLKVEASNPYVEPR
FLYLGPFKDSATVRIVVEDVDEPPVF-
SKLAYILQIREDAQINTTIGSVTAQDPDAARNPV KYS-
VDRHTDMDRIFNIDSGNGSIFTSKLL-
DRETLLWHNITVIATEINNPKQSSRVPLYIKV
LDVNDNAPEFAEFYETFVCEKAKADQ corresponding to amino acids 1-504 of CAD6_HUMAN, which also corresponds to amino acids 1-504 of H53393_PEA_1_P3 (SEQ ID NO: 186), and a second amino acid sequence being at least 70%, optionally at least 80%, preferably at least 85%, more preferably at least 90% and most preferably at least 95% homologous to a polypeptide having the sequence RFGFSLS (SEQ ID NO: 1133) corresponding to amino acids 505-511 of H53393_PEA_1_P3 (SEQ ID NO: 186), wherein said first and second amino acid sequences are contiguous and in a sequential order.

2. An isolated polypeptide encoding for a tail of H53393_PEA_1_P3 (SEQ ID NO: 186), comprising a polypeptide being at least 70%, optionally at least about 80%, preferably at least about 85%, more preferably at least about 90% and most preferably at least about 95% homologous to the sequence RFGFSLS (SEQ ID NO: 1133) in H53393_PEA_1_P3 (SEQ ID NO: 186).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H53393_PEA_1_P3 (SEQ ID NO: 186) is encoded by the following transcript(s): H53393_PEA_1_T11 (SEQ ID NO: 165) and H53393_PEA_1_T3 (SEQ ID NO: 166), for which the sequence(s) is/are given at the end of the application.

The coding portion of transcript H53393_PEA_1_T11 (SEQ ID NO: 165) is shown in bold; this coding portion starts at position 327 and ends at position 1859. The transcript also has the following SNPs as listed in Table 8 (given according to their position on the nucleotide sequence, with the alternative nucleic acid listed; the last column indicates whether the SNP is known or not; the presence of known SNPs in variant protein H53393_PEA_1_P3 (SEQ ID NO: 186) sequence provides support for the deduced sequence of this variant protein according to the present invention).

TABLE 8

Nucleic acid SNPs

| SNP position on nucleotide sequence | Alternative nucleic acid | Previously known SNP? |
|---|---|---|
| 1208 | C -> T | Yes |
| 1407 | T -> C | Yes |
| 1871 | T -> C | Yes |
| 1906 | G -> A | Yes |
| 2329 | C -> T | Yes |
| 2756 | T -> C | Yes |
| 2782 | G -> T | Yes |

The coding portion of transcript H53393_PEA_1_T3 (SEQ ID NO: 166) is shown in bold; this coding portion starts at position 327 and ends at position 1859. The transcript also has the following SNPs as listed in Table 9 (given according to their position on the nucleotide sequence, with the alternative nucleic acid listed; the last column indicates whether the SNP is known or not; the presence of known SNPs in variant protein H53393_PEA_1_P3 (SEQ ID NO: 186) sequence provides support for the deduced sequence of this variant protein according to the present invention).

TABLE 9

Nucleic acid SNPs

| SNP position on nucleotide sequence | Alternative nucleic acid | Previously known SNP? |
|---|---|---|
| 1208 | C -> T | Yes |
| 1407 | T -> C | Yes |
| 1871 | T -> C | Yes |
| 1906 | G -> A | Yes |
| 2149 | C -> T | Yes |
| 3425 | T -> | No |
| 3492 | C -> G | Yes |

Variant protein H53393_PEA_1_P6 (SEQ ID NO: 187) according to the present invention has an amino acid sequence as given at the end of the application; it is encoded by transcript(s) H53393_PEA_1_T9 (SEQ ID NO: 167). An alignment is given to the known protein (Cadherin-6 precursor) at the end of the application. One or more alignments to one or more previously published protein sequences are given at the end of the application. A brief description of the relationship of the variant protein according to the present invention to each such aligned protein is as follows:

Comparison report between H53393_PEA_1_P6 (SEQ ID NO: 187) and CAD6_HUMAN:

1. An isolated chimeric polypeptide encoding for H53393_PEA_1_P6 (SEQ ID NO: 187), comprising a first amino acid sequence being at least 90% homologous to MRTYRYFLLLFWVGQPYPTLSTPL-SKRTSGFPAKKRALELSGNSKNELNRSKRSWMWN QFFLLEEYTGSDYQYVGKLHS-DQDRGDGSLKYILSGDGAGDLFIINENT-GDIQATKRLD REEKPVYILRAQAINRRTGRPVEPE-SEFIIKIHDINDNEPIFTKEVYTATVPEMSDVGTFVV QVTATDADDPTYGNSAKV-VYSILQGQPYFSVESETGIIKTALLNM-DRENREQYQVVIQA KDMGGQMGGLSGTTTVNITLT-DVNDNPPRFPQSTYQFKTPESSPPGTPIGRIKASDADV GENAEIEYSITDGEGLDMFDVITDQETQEGIITVKK corresponding to amino acids 1-333 of CAD6_HUMAN, which also corresponds to amino acids 1-333 of H53393_PEA_1_P6 (SEQ ID NO: 187), and a second amino acid sequence being at least 70%, optionally at least 80%, preferably at least 85%, more preferably at least 90% and most preferably at least 95% homologous to a polypeptide having the sequence VMPLLKHHTE (SEQ ID NO: 1134) corresponding to amino acids 334-343 of H53393_PEA_1_P6 (SEQ ID NO: 187), wherein said first and second amino acid sequences are contiguous and in a sequential order.

2. An isolated polypeptide encoding for a tail of H53393_PEA_1_P6 (SEQ ID NO: 187), comprising a polypeptide being at least 70%, optionally at least about 80%, preferably at least about 85%, more preferably at least about 90% and most preferably at least about 95% homologous to the sequence VMPLLKHHTE (SEQ ID NO: 1134) in H53393_PEA_1_P6 (SEQ ID NO: 187).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H53393_PEA_1_P6 (SEQ ID NO: 187) is encoded by the following transcript(s): H53393_PEA_1_T9 (SEQ ID NO: 167), for which the sequence(s) is/are given at the end of the application. The coding portion of transcript H53393_PEA_1_T9 (SEQ ID NO: 167) is shown in bold; this coding portion starts at position 327 and ends at position 1355. The transcript also has the following SNPs as listed in Table 10 (given according to their position on the nucleotide sequence, with the alternative nucleic acid listed; the last column indicates whether the SNP is known or not; the presence of known SNPs in variant protein H53393_PEA_1_P6 (SEQ ID NO: 187) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 1208 | C -> T | Yes |

As noted above, cluster H53393 features 16 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster H53393_PEA_1_node_0 (SEQ ID NO: 168) according to the present invention is supported by 10 libraries. The number of libraries was determined as previously described. This segment can be found in the following transcript(s): H53393_PEA_1_T10 (SEQ ID NO: 164), H53393_PEA_1_T11 (SEQ ID NO: 165), H53393_PEA_1_T3 (SEQ ID NO: 166) and H53393_PEA_1_T9 (SEQ ID NO: 167). Table 11 below describes the starting and ending position of this segment on each transcript.

TABLE 11

Segment location on transcripts

| Transcript name | Segment starting position | Segment ending position |
|---|---|---|
| H53393_PEA_1_T10 (SEQ ID NO:164) | 1 | 198 |
| H53393_PEA_1_T11 (SEQ ID NO:165) | 1 | 198 |
| H53393_PEA_1_T3 (SEQ ID NO:166) | 1 | 198 |
| H53393_PEA_1_T9 (SEQ ID NO:167) | 1 | 198 |

Segment cluster H53393_PEA_1_node_10 (SEQ ID NO: 169) according to the present invention is supported by 10 libraries. The number of libraries was determined as previously described. This segment can be found in the following transcript(s): H53393_PEA_1_T10 (SEQ ID NO: 164), H53393_PEA_1_T11 (SEQ ID NO: 165), H53393_PEA_1_T3 (SEQ ID NO: 166) and H53393_PEA_1_T9 (SEQ ID NO: 167). Table 12 below describes the starting and ending position of this segment on each transcript.

TABLE 12

Segment location on transcripts

| Transcript name | Segment starting position | Segment ending position |
|---|---|---|
| H53393_PEA_1_T10 (SEQ ID NO:164) | 970 | 1137 |
| H53393_PEA_1_T11 (SEQ ID NO:165) | 970 | 1137 |
| H53393_PEA_1_T3 (SEQ ID NO:166) | 970 | 1137 |
| H53393_PEA_1_T9 (SEQ ID NO:167) | 970 | 1137 |

Segment cluster H53393_PEA_1_node_12 (SEQ ID NO: 170) according to the present invention is supported by 7 libraries. The number of libraries was determined as previously described. This segment can be found in the following transcript(s): H53393_PEA_1_T10 (SEQ ID NO: 164), H53393_PEA_1_T11 (SEQ ID NO: 165), H53393_PEA_1_T3 (SEQ ID NO: 166) and H53393_PEA_1_T9 (SEQ ID NO: 167). Table 13 below describes the starting and ending position of this segment on each transcript.

TABLE 13

Segment location on transcripts

| Transcript name | Segment starting position | Segment ending position |
|---|---|---|
| H53393_PEA_1_T10 (SEQ ID NO:164) | 1138 | 1325 |
| H53393_PEA_1_T11 (SEQ ID NO:165) | 1138 | 1325 |
| H53393_PEA_1_T3 (SEQ ID NO:166) | 1138 | 1325 |
| H53393_PEA_1_T9 (SEQ ID NO:167) | 1138 | 1325 |

Segment cluster H53393_PEA_1_node_13 (SEQ ID NO: 171) according to the present invention is supported by 2 libraries. The number of libraries was determined as previously described. This segment can be found in the following transcript(s): H53393_PEA_1_T9 (SEQ ID NO: 167). Table 14 below describes the starting and ending position of this segment on each transcript.

TABLE 14

Segment location on transcripts

| Transcript name | Segment starting position | Segment ending position |
|---|---|---|
| H53393_PEA_1_T9 (SEQ ID NO:167) | 1326 | 1625 |

Segment cluster H53393_PEA_1_node_15 (SEQ ID NO: 172) according to the present invention is supported by 11 libraries. The number of libraries was determined as previously described. This segment can be found in the following transcript(s): H53393_PEA_1_T10 (SEQ ID NO: 164), H53393_PEA_1_T11 (SEQ ID NO: 165) and H53393_PEA_1_T3 (SEQ ID NO: 166). Table 15 below describes the starting and ending position of this segment on each transcript.

TABLE 15

Segment location on transcripts

| Transcript name | Segment starting position | Segment ending position |
|---|---|---|
| H53393_PEA_1_T10 (SEQ ID NO:164) | 1326 | 1579 |
| H53393_PEA_1_T11 (SEQ ID NO:165) | 1326 | 1579 |
| H53393_PEA_1_T3 (SEQ ID NO:166) | 1326 | 1579 |

Segment cluster H53393_PEA_1_node_17 (SEQ ID NO: 173) according to the present invention is supported by 13 libraries. The number of libraries was determined as previously described. This segment can be found in the following transcript(s): H53393_PEA_1_T10 (SEQ ID NO: 164), H53393_PEA_1_T11 (SEQ ID NO: 165) and H53393_PEA_1_T3 (SEQ ID NO: 166). Table 16 below describes the starting and ending position of this segment on each transcript.

TABLE 16

Segment location on transcripts

| Transcript name | Segment starting position | Segment ending position |
|---|---|---|
| H53393_PEA_1_T10 (SEQ ID NO:164) | 1580 | 1716 |
| H53393_PEA_1_T11 (SEQ ID NO:165) | 1580 | 1716 |
| H53393_PEA_1_T3 (SEQ ID NO:166) | 1580 | 1716 |

Segment cluster H53393_PEA_1_node_19 (SEQ ID NO: 174) according to the present invention is supported by 16 libraries. The number of libraries was determined as previously described. This segment can be found in the following transcript(s): H53393_PEA_1_T10 (SEQ ID NO: 164), H53393_PEA_1_T11 (SEQ ID NO: 165) and H53393_PEA_1_T3 (SEQ ID NO: 166). Table 17 below describes the starting and ending position of this segment on each transcript.

TABLE 17

Segment location on transcripts

| Transcript name | Segment starting position | Segment ending position |
|---|---|---|
| H53393_PEA_1_T10 (SEQ ID NO:164) | 1717 | 1838 |
| H53393_PEA_1_T11 (SEQ ID NO:165) | 1717 | 1838 |
| H53393_PEA_1_T3 (SEQ ID NO:166) | 1717 | 1838 |

Segment cluster H53393_PEA_1_node_23 (SEQ ID NO: 175) according to the present invention is supported by 1 libraries. The number of libraries was determined as previously described. This segment can be found in the following transcript(s): H53393_PEA_1_T10 (SEQ ID NO: 164) and H53393_PEA_1_T11 (SEQ ID NO: 165). Table 18 below describes the starting and ending position of this segment on each transcript.

TABLE 18

Segment location on transcripts

| Transcript name | Segment starting position | Segment ending position |
|---|---|---|
| H53393_PEA_1_T10 (SEQ ID NO:164) | 1957 | 2136 |
| H53393_PEA_1_T11 (SEQ ID NO:165) | 1977 | 2156 |

Segment cluster H53393_PEA_1_node_24 (SEQ ID NO: 176) according to the present invention is supported by 19 libraries. The number of libraries was determined as previously described. This segment can be found in the following transcript(s): H53393_PEA_1_T10 (SEQ ID NO: 164), H53393_PEA_1_T11 (SEQ ID NO: 165) and H53393_PEA_1_T3 (SEQ ID NO: 166). Table 19 below describes the starting and ending position of this segment on each transcript.

TABLE 19

Segment location on transcripts

| Transcript name | Segment starting position | Segment ending position |
|---|---|---|
| H53393_PEA_1_T10 (SEQ ID NO:164) | 2137 | 2388 |
| H53393_PEA_1_T11 (SEQ ID NO:165) | 2157 | 2408 |
| H53393_PEA_1_T3 (SEQ ID NO:166) | 1977 | 2228 |

Segment cluster H53393_PEA_1_node_25 (SEQ ID NO: 177) according to the present invention is supported by 6 libraries. The number of libraries was determined as previously described. This segment can be found in the following transcript(s): H53393_PEA_1_T10 (SEQ ID NO: 164) and H53393_PEA_1_T11 (SEQ ID NO: 165). Table 20 below describes the starting and ending position of this segment on each transcript.

TABLE 20

Segment location on transcripts

| Transcript name | Segment starting position | Segment ending position |
|---|---|---|
| H53393_PEA_1_T10 (SEQ ID NO:164) | 2389 | 2873 |
| H53393_PEA_1_T11 (SEQ ID NO:165) | 2409 | 2893 |

Segment cluster H53393_PEA_1_node_29 (SEQ ID NO: 178) according to the present invention is supported by 41 libraries. The number of libraries was determined as previously described. This segment can be found in the following transcript(s): H53393_PEA_1_T3 (SEQ ID NO: 166). Table 21 below describes the starting and ending position of this segment on each transcript.

TABLE 21

Segment location on transcripts

| Transcript name | Segment starting position | Segment ending position |
|---|---|---|
| H53393_PEA_1_T3 (SEQ ID NO:166) | 2229 | 3998 |

Segment cluster H53393_PEA_1_node_4 (SEQ ID NO: 179) according to the present invention is supported by 12 libraries. The number of libraries was determined as previously described. This segment can be found in the following transcript(s): H53393_PEA_1_T10 (SEQ ID NO: 164), H53393_PEA_1_T11 (SEQ ID NO: 165), H53393_PEA_1_T3 (SEQ ID NO: 166) and H53393_PEA_1_T9 (SEQ ID NO: 167). Table 22 below describes the starting and ending position of this segment on each transcript.

TABLE 22

Segment location on transcripts

| Transcript name | Segment starting position | Segment ending position |
|---|---|---|
| H53393_PEA_1_T10 (SEQ ID NO:164) | 199 | 554 |
| H53393_PEA_1_T11 (SEQ ID NO:165) | 199 | 554 |
| H53393_PEA_1_T3 (SEQ ID NO:166) | 199 | 554 |
| H53393_PEA_1_T9 (SEQ ID NO:167) | 199 | 554 |

Segment cluster H53393_PEA_1_node_6 (SEQ ID NO: 180) according to the present invention is supported by 14 libraries. The number of libraries was determined as previously described. This segment can be found in the following transcript(s): H53393_PEA_1_T10 (SEQ ID NO: 164), H53393_PEA_1_T11 (SEQ ID NO: 165), H53393_PEA_1_T3 (SEQ ID NO: 166) and H53393_PEA_1_T9 (SEQ ID NO: 167). Table 23 below describes the starting and ending position of this segment on each transcript.

TABLE 23

Segment location on transcripts

| Transcript name | Segment starting position | Segment ending position |
|---|---|---|
| H53393_PEA_1_T10 (SEQ ID NO:164) | 555 | 849 |
| H53393_PEA_1_T11 (SEQ ID NO:165) | 555 | 849 |
| H53393_PEA_1_T3 (SEQ ID NO:166) | 555 | 849 |
| H53393_PEA_1_T9 (SEQ ID NO:167) | 555 | 849 |

Segment cluster H53393_PEA_1_node_8 (SEQ ID NO: 181) according to the present invention is supported by 12 libraries. The number of libraries was determined as previously described. This segment can be found in the following transcript(s): H53393_PEA_1_T10 (SEQ ID NO: 164), H53393_PEA_1_T11 (SEQ ID NO: 165), H53393_PEA_1_T3 (SEQ ID NO: 166) and H53393_PEA_1_T9 (SEQ ID NO: 167). Table 24 below describes the starting and ending position of this segment on each transcript.

TABLE 24

Segment location on transcripts

| Transcript name | Segment starting position | Segment ending position |
|---|---|---|
| H53393_PEA_1_T10 (SEQ ID NO:164) | 850 | 969 |
| H53393_PEA_1_T11 (SEQ ID NO:165) | 850 | 969 |
| H53393_PEA_1_T3 (SEQ ID NO:166) | 850 | 969 |
| H53393_PEA_1_T9 (SEQ ID NO:167) | 850 | 969 |

According to an optional embodiment of the present invention, short segments related to the above cluster are also provided. These segments are up to about 120 bp in length, and so are included in a separate description.

Segment cluster H53393_PEA_1_node_21 (SEQ ID NO: 182) according to the present invention can be found in the following transcript(s): H53393_PEA_1_T11 (SEQ ID NO: 165) and H53393_PEA_1_T3 (SEQ ID NO: 166). Table 25 below describes the starting and ending position of this segment on each transcript.

TABLE 25

Segment location on transcripts

| Transcript name | Segment starting position | Segment ending position |
|---|---|---|
| H53393_PEA_1_T11 (SEQ ID NO:165) | 1839 | 1858 |
| H53393_PEA_1_T3 (SEQ ID NO:166) | 1839 | 1858 |

Segment cluster H53393_PEA_1_node_22 (SEQ ID NO: 183) according to the present invention is supported by 16 libraries. The number of libraries was determined as previously described. This segment can be found in the following transcript(s): H53393_PEA_1_T10 (SEQ ID NO: 164), H53393_PEA_1_T11 (SEQ ID NO: 165) and H53393_PEA_1_T3 (SEQ ID NO: 166). Table 26 below describes the starting and ending position of this segment on each transcript.

TABLE 26

Segment location on transcripts

| Transcript name | Segment starting position | Segment ending position |
|---|---|---|
| H53393_PEA_1_T10 (SEQ ID NO:164) | 1839 | 1956 |
| H53393_PEA_1_T11 (SEQ ID NO:165) | 1859 | 1976 |
| H53393_PEA_1_T3 (SEQ ID NO:166) | 1859 | 1976 |

Variant protein alignment to the previously known protein:

Sequence name: /tmp/oAlc9u2qp7/1HgSZJi6aI: CAD6_HUMAN

Sequence documentation:

Alignment of: H53393_PEA_1_P2 (SEQ ID NO: 185) x CAD6_HUMAN . . .

Alignment segment 1/1:
   Quality: 5281.00

Escore: 0
   Matching length: 543 Total length: 543

Matching Percent Similarity: 100.00 Matching Percent Identity: 100.00
   Total Percent Similarity: 100.00 Total Percent Identity: 100.00
   Gaps: 0

Alignment:

```
  1  MRTYRYFLLLFWVGQPYPTLSTPLSKRTSGFPAKKRALELSGNSKNELNR   50
     ||||||||||||||||||||||||||||||||||||||||||||||||||
  1  MRTYRYFLLLFWVGQPYPTLSTPLSKRTSGFPAKKRALELSGNSKNELNR   50

51  SKRSWMWNQFFLLEEYTGSDYQYVGKLHSDQDRGDGSLKYILSGDGAGDL  100
     ||||||||||||||||||||||||||||||||||||||||||||||||||
 51  SKRSWMWNQFFLLEEYTGSDYQYVGKLHSDQDRGDGSLKYILSGDGAGDL  100

101  FIINENTGDIQATKRLDREEKPVYILRAQAINRRTGRPVEPESEFIIKIH  150
     ||||||||||||||||||||||||||||||||||||||||||||||||||
101  FIINENTGDIQATKRLDREEKPVYILRAQAINRRTGRPVEPESEFIIKIH  150

151  DINDNEPIFTKEVYTATVPEMSDVGTFVVQVTATDADDPTYGNSAKVVYS  200
     ||||||||||||||||||||||||||||||||||||||||||||||||||
151  DINDNEPIFTKEVYTATVPEMSDVGTFVVQVTATDADDPTYGNSAKVVYS  200

201  ILQGQPYFSVESETGIIKTALLNMDRENREQYQVVIQAKDMGGQMGGLSG  250
     ||||||||||||||||||||||||||||||||||||||||||||||||||
201  ILQGQPYFSVESETGIIKTALLNMDRENREQYQVVIQAKDMGGQMGGLSG  250

251  TTTVNITLTDVNDNPPRFPQSTYQFKTPESSPPGTPIGRIKASDADVGEN  300
     ||||||||||||||||||||||||||||||||||||||||||||||||||
251  TTTVNITLTDVNDNPPRFPQSTYQFKTPESSPPGTPIGRIKASDADVGEN  300

301  AEIEYSITDGEGLDMFDVITDQETQEGIITVKKLLDFEKKKVYTLKVEAS  350
     ||||||||||||||||||||||||||||||||||||||||||||||||||
301  AEIEYSITDGEGLDMFDVITDQETQEGIITVKKLLDFEKKKVYTLKVEAS  350

351  NPYVEPRFLYLGPFKDSATVRIVVEDVDEPPVFSKLAYILQIREDAQINT  400
     ||||||||||||||||||||||||||||||||||||||||||||||||||
351  NPYVEPRFLYLGPFKDSATVRIVVEDVDEPPVFSKLAYILQIREDAQINT  400

401  TIGSVTAQDPDAARNPVKYSVDRHTDMDRIFNIDSGNGSIFTSKLLDRET  450
     ||||||||||||||||||||||||||||||||||||||||||||||||||
401  TIGSVTAQDPDAARNPVKYSVDRHTDMDRIFNIDSGNGSIFTSKLLDRET  450

451  LLWHNITVIATEINNPKQSSRVPLYIKVLDVNDNAPEFAEFYETFVCEKA  500
     ||||||||||||||||||||||||||||||||||||||||||||||||||
451  LLWHNITVIATEINNPKQSSRVPLYIKVLDVNDNAPEFAEFYETFVCEKA  500

501  KADQLIQTLHAVDKDDPYSGHQFSFSLAPEAASGSNFTIQDNK         543
     ||||||||||||||||||||||||||||||||||||||||||
501  KADQLIQTLHAVDKDDPYSGHQFSFSLAPEAASGSNFTIQDNK         543
```

Sequence name: /tmp/I80QylyXbk/TP0IdL1tx5: CAD6_HUMAN

Sequence documentation:

Alignment of: H53393_PEA_1_P3 (SEQ ID NO: 186) x CAD6_HUMAN...

Alignment segment 1/1:
   Quality: 4900.00

Escore: 0
   Matching length: 504 Total length: 504

Matching Percent Similarity: 100.00 Matching Percent Identity: 100.00
   Total Percent Similarity: 100.00 Total Percent Identity: 100.00
   Gaps: 0

Alignment:

```
  1  MRTYRYFLLLFWVGQPYPTLSTPLSKRTSGFPAKKRALELSGNSKNELNR   50
     ||||||||||||||||||||||||||||||||||||||||||||||||||
  1  MRTYRYFLLLFWVGQPYPTLSTPLSKRTSGFPAKKRALELSGNSKNELNR   50

51  SKRSWMWNQFFLLEEYTGSDYQYVGKLHSDQDRGDGSLKYILSGDGAGDL  100
     ||||||||||||||||||||||||||||||||||||||||||||||||||
 51  SKRSWMWNQFFLLEEYTGSDYQYVGKLHSDQDRGDGSLKYILSGDGAGDL  100

101  FIINENTGDIQATKRLDREEKPVYILRAQAINRRTGRPVEPESEFIIKIH  150
     ||||||||||||||||||||||||||||||||||||||||||||||||||
101  FIINENTGDIQATKRLDREEKPVYILRAQAINRRTGRPVEPESEFIIKIH  150
```

-continued

```
151  DINDNEPIFTKEVYTATVPEMSDVGTFVVQVTATDADDPTYGNSAKVVYS  200
     ||||||||||||||||||||||||||||||||||||||||||||||||||
151  DINDNEPIFTKEVYTATVPEMSDVGTFVVQVTATDADDPTYGNSAKVVYS  200
201  ILQGQPYFSVESETGIIKTALLNMDRENREQYQVVIQAKDMGGQMGGLSG  250
     ||||||||||||||||||||||||||||||||||||||||||||||||||
201  ILQGQPYFSVESETGIIKTALLNMDRENREQYQVVIQAKDMGGQMGGLSG  250
251  TTTVNITLTDVNDNPPRFPQSTYQFKTPESSPPGTPIGRIKASDADVGEN  300
     ||||||||||||||||||||||||||||||||||||||||||||||||||
251  TTTVNITLTDVNDNPPRFPQSTYQFKTPESSPPGTPIGRIKASDADVGEN  300
301  AEIEYSITDGEGLDMFDVITDQETQEGIITVKKLLDFEKKKVYTLKVEAS  350
     ||||||||||||||||||||||||||||||||||||||||||||||||||
301  AEIEYSITDGEGLDMFDVITDQETQEGIITVKKLLDFEKKKVTYLKVEAS  350
351  NPYVEPRFLYLGPFKDSATVRIVVEDVDEPPVFSKLAYILQIREDAQINT  400
     ||||||||||||||||||||||||||||||||||||||||||||||||||
351  NPYVEPRFLYLGPFKDSATVRIVVEDVDEPPVFSKLAYILQIREDAQINT  400
401  TIGSVTAQDPDAARNPVKYSVDRHTDMDRIFNIDSGNGSIFTSKLLDRET  450
     ||||||||||||||||||||||||||||||||||||||||||||||||||
401  TIGSVTAQDPDAARNPVKYSVDRHTDMDRIFNIDSGNGSIFTSKLLDRET  450
451  LLWHNITVIATEINNPKQSSRVPLYIKVLDVNDNAPEFAEFYETFVCEKA  500
     ||||||||||||||||||||||||||||||||||||||||||||||||||
451  LLWHNITVIATEINNPKQSSRVPLYIKVLDVNDNAPEFAEFYETFVCEKA  500
501  KADQ                                                504
     ||||
501  KADQ                                                504
```

Sequence name: /tmp/NtvjwylOCi/c5Li3O91on:
CAD6_HUMAN

Sequence documentation:

Identity: 99.40
Gaps: 0
Alignment:

```
  1  MRTYRYFLLLFWVGQPYPTLSTPLSKRTSGFPAKKRALELSGNSKNELNR   50
     ||||||||||||||||||||||||||||||||||||||||||||||||||
  1  MRTYRYFLLLFWVGQPYPTLSTPLSKRTSGFPAKKRALELSGNSKNELNR   50
 51  SKRSWMWNQFFLLEEYTGSDYQYVGKLHSDQDRGDGSLKYILSGDGAGDL  100
     ||||||||||||||||||||||||||||||||||||||||||||||||||
 51  SKRSWMWNQFFLLEEYTGSDYQYVGKLHSDQDRGDGSLKYILSGDGAGDL  100
101  FIINENTGDIQATKRLDREEKPVYILRAQAINRRTGRPVEPESEFIIKIH  150
     ||||||||||||||||||||||||||||||||||||||||||||||||||
101  FIINENTGDIQATKRLDREEKPVYILRAQAINRRTGRPVEPESEFIIKIH  150
151  DINDNEPIFTKEVYTATVPEMSDVGTFVVQVTATDADDPTYGNSAKVVYS  200
     ||||||||||||||||||||||||||||||||||||||||||||||||||
151  DINDNEPIFTKEVYTATVPEMSDVGTFVVQVTATDADDPTYGNSAKVVYS  200
201  ILQGQPYFSVESETGIIKTALLNMDRENREQYQVVIQAKDMGGQMGGLSG  250
     ||||||||||||||||||||||||||||||||||||||||||||||||||
201  ILQGQPYFSVESETGIIKTALLNMDRENREQYQVVIQAKDMGGQMGGLSG  250
251  TTTVNITLTDVNDNPPRFPQSTYQFKTPESSPPGTPIGRIKASDADVGEN  300
     ||||||||||||||||||||||||||||||||||||||||||||||||||
251  TTTVNITLTDVNDNPPRFPQSTYQFKTPESSPPGTPIGRIKASDADVGEN  300
301  AEIEYSITDGEGLDMFDVITDQETQEGIITVKKVM                 335
     |||||||||||||||||||||||||||||||||
301  AEIEYSITDGEGLDMFDVITDQETQEGIITVKKLL                 335
```

Alignment of: H53393_PEA_1_P6 (SEQ ID NO: 187) x CAD6_HUMAN . . .

Alignment segment 1/1:

Quality: 3247.00

Escore: 0

Matching length: 335 Total length: 335

Matching Percent Similarity: 100.00 Matching Percent

Identity: 99.40

Total Percent Similarity: 100.00 Total Percent

Expression of CAD6_HUMAN Cadherin-6 [Precursor]; Kidney-Cadherin; K-Cadherin H53393 Transcripts which are Detectable by Amplicon as Depicted in Sequence Name H53393 seg13 (SEQ ID NO:981) in Normal and Cancerous Ovary Tissues Expression of CAD6_HUMAN Cadherin-6 [Precursor]; Kidney-cadherin; K-cadherin transcripts detectable by or according to seg13, H53393 seg13 (SEQ ID NO:981) amplicon(s) and H53393 seg13F (SEQ ID NO:979) and H53393 seg13R (SEQ ID NO:980) primers was measured by real time PCR. In this specific example, the real-time PCR reaction efficiency was assumed to be 2 and was not calculated by a standard curve reaction (as detailed above in the section of "Real-Time RT-PCR analysis"). In parallel the expression of four housekeeping genes —PBGD (GenBank Accession No. BC019323, (SEQ ID NO:1036); amplicon—PBGD-amplicon, (SEQ ID NO:1039)), HPRT1 (GenBank Accession No. NM_000194, (SEQ ID NO: 1040); amplicon—HPRT1-amplicon, (SEQ ID NO: 1043)), SDHA (GenBank Accession No. NM_004168, (SEQ ID NO: 1032); amplicon—SDHA-amplicon, (SEQ ID NO: 1035)), and GAPDH (GenBank Accession No. BC026907, (SEQ ID NO: 1044); GAPDH amplicon, (SEQ ID NO:1047)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45-48, 71, Table 1, "Tissue samples in testing panel", above), to obtain a value of fold up-regulation for each sample relative to median of the normal PM samples.

Figure 21:
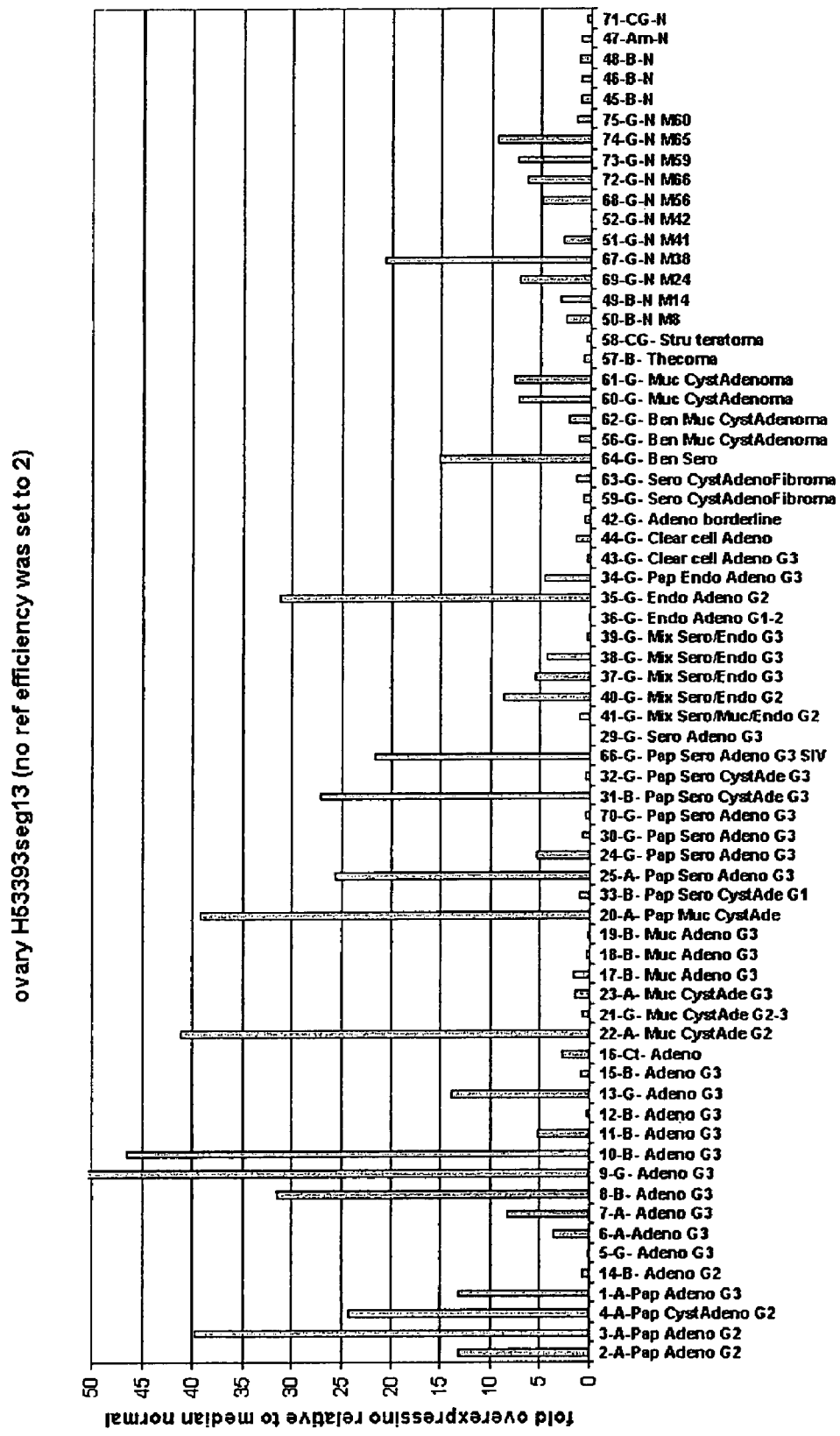
FIG. 21 is a histogram showing over expression of H53393 seg13 (SEQ ID NO:981) transcripts in cancerous ovary samples relative to the normal samples.

FIG. 21 is a histogram showing over expression of the above-indicated CAD6_HUMAN Cadherin-6 [Precursor] transcripts in cancerous ovary samples relative to the normal samples.

As is evident from FIG. 21, the expression of CAD6_HUMAN Cadherin-6 [Precursor] transcripts detectable by the above amplicon(s) in cancer samples was significantly higher than in the non-cancerous samples (Sample Nos. 45-48, 71 Table 1, "Tissue samples in testing panel"). Notably an over-expression of at least 5 fold was found in 19 out of 43 adenocarcinoma samples.

Statistical analysis was applied to verify the significance of these results, as described below. The P value for the difference in the expression levels of CAD6_HUMAN Cadherin-6 [Precursor] transcripts detectable by the above amplicon(s) in ovary cancer samples versus the normal tissue samples was determined by T test as 5.5E-03.

Threshold of 5 fold overexpression was found to differentiate between cancer and normal samples with P value of 6.94E-02 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: H53393 seg13F (SEQ ID NO:979) forward primer; and H53393 seg13R (SEQ ID NO:980) reverse primer.

The present invention also preferably encompasses any amplicon obtained through the use of any suitable primer pair; for example, for the above experiment, the following amplicon was obtained as a non-limiting illustrative example only of a suitable amplicon: H53393 seg13. H53393 seg13 Forward primer (SEQ ID NO:979): AATGCCGCTTCT-TAAACACCA H53393 seg13 Reverse primer (SEQ ID NO:980): AGAACTGGCATTTTTCTGAAAATAATAA H53393 seg13 Amplicon (SEQ ID NO:981): AATGCCGCT-TCTTAAACACCATACAGAGTGAAC-CCATTTACTTTTCTCCAGTTCCTA AGTTAC-CAGGGGCAATTATATCTCACATAAACATTCCTTTAGA TTTTTATTTTACTTA TTATTTTCAGAAAAATGCCAGT-TCT Expression of CAD6_HUMAN Cadherin-6 [Precursor] H53393 transcripts which are detectable by amplicon as depicted in sequence name H53393 junc21-22 (SEQ ID NO:984) in normal and cancerous ovary tissues Expression of CAD6_HUMAN Cadherin-6 [Precursor] transcripts detectable by or according to junc21-22, H53393 junc21-22 (SEQ ID NO:984) amplicon(s) and H53393 junc21-22F (SEQ ID NO:982) and H53393 junc21-22R (SEQ ID NO:983) primers was measured by real time PCR. In this specific example, the real-time PCR reaction efficiency was assumed to be 2 and was not calculated by a standard curve reaction (as detailed above in the section of "Real-Time RT-PCR analysis"). In parallel the expression of four housekeeping genes —PBGD (GenBank Accession No. BC019323, (SEQ ID NO:1036); amplicon—PBGD-amplicon, (SEQ ID NO: 1039)), HPRT1 (GenBank Accession No. NM_000194, (SEQ ID NO: 1040); amplicon—HPRT1-amplicon, (SEQ ID NO:1043)), SDHA (GenBank Accession No. NM_004168, (SEQ ID NO: 1032); amplicon—SDHA-amplicon, (SEQ ID NO: 1035)), and GAPDH (GenBank Accession No. BC026907, (SEQ ID NO:1044); GAPDH amplicon, (SEQ ID NO:1047)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45-48, 71 Table 1, "Tissue samples in testing panel", above), to obtain a value of fold up-regulation for each sample relative to median of the normal PM samples.

Figure 22:
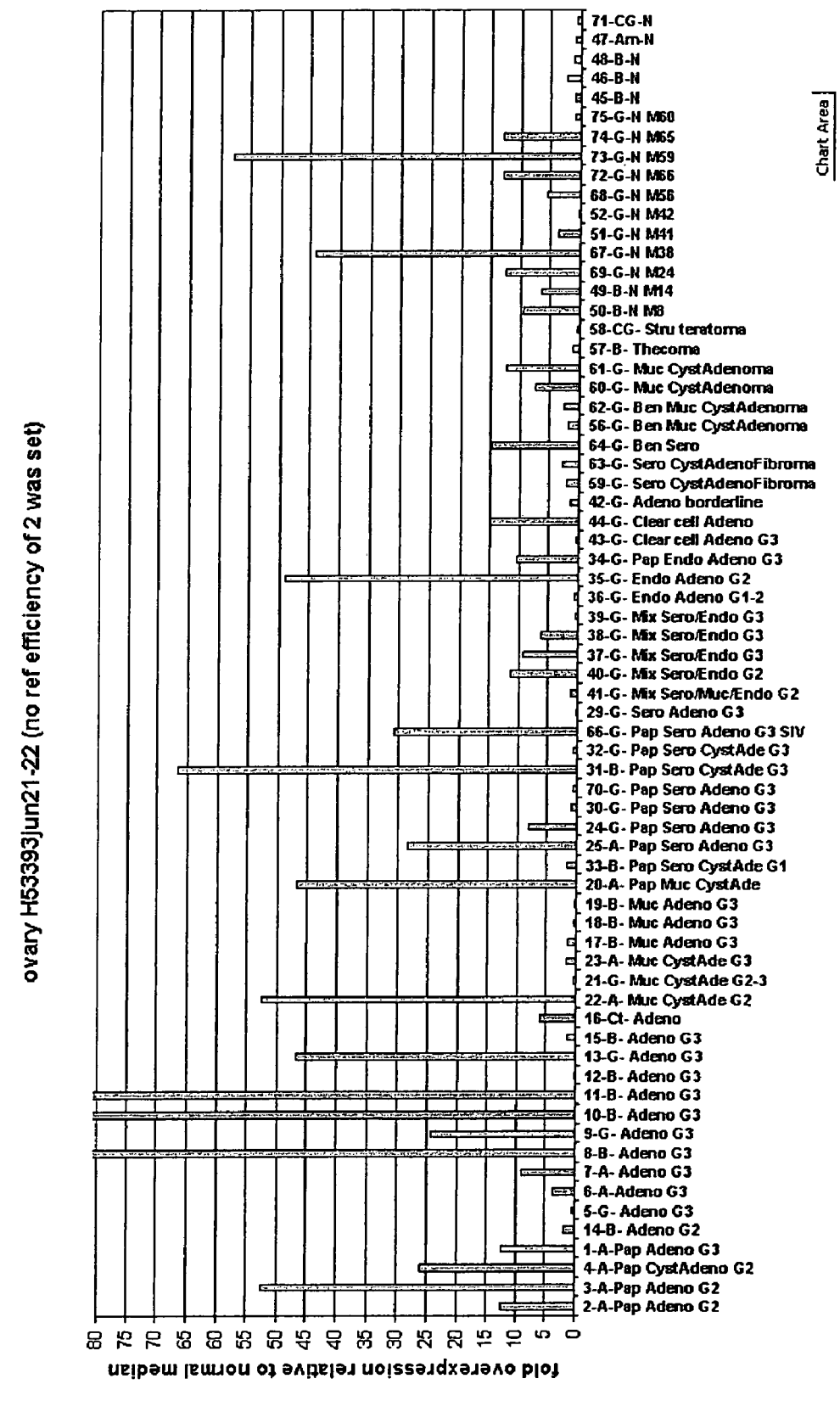
FIG. 22 is a histogram showing over expression of H53393 junc21-22 (SEQ ID NO:984) transcripts in cancerous ovary samples relative to the normal samples.

FIG. 22 is a histogram showing over expression of the above-indicated CAD6_HUMAN Cadherin-6 [Precursor] transcripts in cancerous ovary samples relative to the normal samples. As is evident from FIG. 22, the expression of CAD6_HUMAN Cadherin-6 [Precursor] transcripts detectable by the above amplicon(s) in cancer samples was higher than in the non-cancerous samples (Sample Nos. 45-48, 71 Table 1, "Tissue samples in testing panel"). Notably an over-expression of at least 5 fold was found in 23 out of 43 adenocarcinoma samples.

Primer pairs are also optionally and preferably encompassed within the present invention; for example, for the above experiment, the following primer pair was used as a non-limiting illustrative example only of a suitable primer pair: H53393 junc21-22F (SEQ ID NO:982) forward primer; and H53393 junc21-22R (SEQ ID NO:983) reverse primer.

The present invention also preferably encompasses any amplicon obtained through the use of any suitable primer pair; for example, for the above experiment, the following amplicon was obtained as a non-limiting illustrative example only of a suitable amplicon: H53393 junc21-22 (SEQ ID NO:984). H53393 junc21-22 Forward primer (SEQ ID NO:982): TGGTTTTTCTCTTAGTTGATTCAGACC H53393 junc21-22 Reverse primer (SEQ ID NO:983): GAGCCACTGGCTGCTTCAG H53393 junc21-22 Amplicon (SEQ ID NO:984): TGGTTTTTCTCTTAGTTGAT-TCAGACCTTGCATGCTGTTGACAAGGAT-GACCCTTATA GTGGGCACCAATTTTCGTTTTCCTTGGC-CCCTGAAGCAGCCAGTGGCTC

DESCRIPTION FOR CLUSTER HSU40434

Cluster HSU40434 features 1 transcript(s) and 36 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| HSU40434_PEA_1_T13 | 188 |

TABLE 2

Segments of interest

| Segment Name | SEQ ID NO: |
|---|---|
| HSU40434_PEA_1_node_1 | 189 |
| HSU40434_PEA_1_node_16 | 190 |
| HSU40434_PEA_1_node_30 | 191 |
| HSU40434_PEA_1_node_32 | 192 |
| HSU40434_PEA_1_node_57 | 193 |
| H5U40434_PEA_1_node_0 | 194 |
| HSU40434_PEA_1_node_10 | 195 |
| HSU40434_PEA_1_node_13 | 196 |
| HSU40434_PEA_1_node_18 | 197 |
| HSU40434_PEA_1_node_2 | 198 |
| HSU40434_PEA_1_node_20 | 199 |
| HSU40434_PEA_1_node_21 | 200 |
| HSU40434_PEA_1_node_23 | 201 |
| HSU40434_PEA_1_node_24 | 202 |
| HSU40434_PEA_1_node_26 | 203 |
| HSU40434_PEA_1_node_28 | 204 |
| HSU40434_PEA_1_node_3 | 205 |
| HSU40434_PEA_1_node_35 | 206 |
| HSU40434_PEA_1_node_36 | 207 |
| HSU40434_PEA_1_node_37 | 208 |
| HSU40434_PEA_1_node_38 | 209 |
| HSU40434_PEA_1_node_39 | 210 |
| HSU40434_PEA_1_node_40 | 211 |
| HSU40434_PEA_1_node_41 | 212 |
| HSU40434_PEA_1_node_42 | 213 |
| HSU40434_PEA_1_node_43 | 214 |
| HSU40434_PEA_1_node_44 | 215 |
| HSU40434_PEA_1_node_47 | 216 |
| HSU40434_PEA_1_node_48 | 217 |
| HSU40434_PEA_1_node_51 | 218 |
| HSU40434_PEA_1_node_52 | 219 |
| HSU40434_PEA_1_node_53 | 220 |
| HSU40434_PEA_1_node_54 | 221 |
| HSU40434_PEA_1_node_56 | 222 |
| HSU40434_PEA_1_node_7 | 223 |
| HSU40434_PEA_1_node_8 | 224 |

TABLE 3

Proteins of interest

| Protein Name | SEQ ID NO: |
|---|---|
| HSU40434_PEA_1_P12 | 226 |

These sequences are variants of the known protein Mesothelin precursor (SwissProt accession identifier MSLN_HUMAN; known also according to the synonym CAK1 antigen), SEQ ID NO: 225, referred to herein as the previously known protein.

The variant proteins according to the present invention are variants of a known diagnostic marker, called Mesothelin (CAK-1).

Protein Mesothelin precursor is known or believed to have the following function(s): may play a role in cellular adhesion. Antigenic protein reactive with antibody K1. The sequence for protein Mesothelin precursor is given at the end of the application, as "Mesothelin precursor amino acid sequence". Protein Mesothelin precursor localization is believed to be attached to the membrane by a GPI-anchor.

The following GO Annotation(s) apply to the previously known protein. The following annotation(s) were found: cell adhesion, which are annotation(s) related to Biological Process; protein binding, which are annotation(s) related to Molecular Function; and membrane, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster HSU40434 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 23 refer to weighted expression of ESTs in each category, as "parts per million" (ratio of the expression of ESTs for a particular cluster to the expression of all ESTs in that category, according to parts per million).

Figure 23:
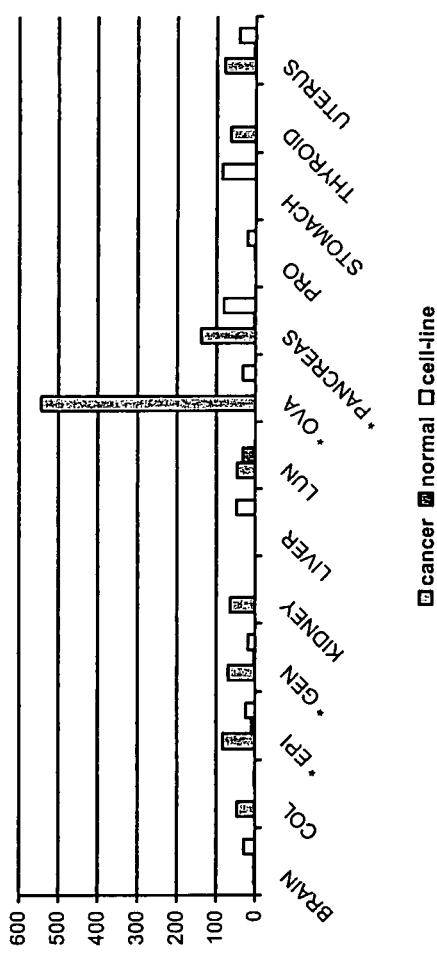
FIG. 23 shows cancer and cell-line vs. normal tissue expression.

Overall, the following results were obtained as shown with regard to the histograms in FIG. 23 and Table 4. This cluster is overexpressed (at least at a minimum level) in the following pathological conditions: epithelial malignant tumors, a mixture of malignant tumors from different tissues, ovarian carcinoma and pancreas carcinoma.

TABLE 4

Normal tissue distribution

| Name of Tissue | Number |
|---|---|
| brain | 2 |
| colon | 0 |
| epithelial | 9 |
| general | 4 |
| kidney | 0 |
| liver | 0 |
| lung | 32 |
| ovary | 0 |
| pancreas | 2 |
| prostate | 2 |
| stomach | 0 |
| Thyroid | 0 |
| uterus | 4 |

TABLE 5

P values and ratios for expression in cancerous tissue

| Name of Tissue | P1 | P2 | SP1 | R3 | SP2 | R4 |
|---|---|---|---|---|---|---|
| brain | 5.1e−01 | 3.1e−01 | 1 | 0.9 | 2.5e−01 | 2.7 |
| colon | 1.7e−01 | 1.7e−01 | 3.4e−01 | 2.4 | 4.6e−01 | 2.0 |
| epithelial | 4.3e−03 | 2.3e−03 | 9.3e−12 | 6.7 | 6.1e−08 | 4.5 |
| general | 4.0e−05 | 1.5e−05 | 3.9e−24 | 11.6 | 1.5e−17 | 7.5 |
| kidney | 4.1e−01 | 5.1e−01 | 1.1e−01 | 3.2 | 2.4e−01 | 2.3 |
| liver | 1 | 6.8e−01 | 1 | 1.0 | 4.8e−01 | 1.9 |
| lung | 5.4e−01 | 7.9e−01 | 4.8e−01 | 1.3 | 8.4e−01 | 0.7 |
| ovary | 8.2e−02 | 6.3e−02 | 4.8e−06 | 11.3 | 1.5e−04 | 8.0 |
| pancreas | 2.3e−01 | 8.7e−02 | 1.8e−04 | 5.4 | 2.4e−04 | 6.1 |
| prostate | 9.7e−01 | 9.3e−01 | 1 | 0.9 | 7.5e−01 | 1.2 |
| stomach | 1 | 3.0e−01 | 1 | 1.0 | 2.1e−01 | 2.3 |
| Thyroid | 5.0e−01 | 5.0e−01 | 6.7e−01 | 1.5 | 6.7e−01 | 1.5 |
| uterus | 9.0e−02 | 5.6e−02 | 8.5e−02 | 3.3 | 1.1e−01 | 2.8 |

As noted above, cluster HSU40434 features 1 transcript(s), which were listed in Table 1 above. These transcript(s) encode for protein(s) which are variant(s) of protein Mesothelin precursor. A description of each variant protein according to the present invention is now provided.

Variant protein HSU40434_PEA_1_P12 (SEQ ID NO: 226) according to the present invention has an amino acid sequence as given at the end of the application; it is encoded by transcript(s) HSU40434_PEA_1_T13 (SEQ ID NO: 188). An alignment is given to the known protein (Mesothelin precursor) at the end of the application. One or more alignments to one or more previously published protein sequences are given at the end of the application. A brief description of the relationship of the variant protein according to the present invention to each such aligned protein is as follows:

Comparison report between HSU40434_PEA_1_P12 (SEQ ID NO: 226) and Q14859 (SEQ ID NO: 985) (SEQ ID NO:985):

1. An isolated chimeric polypeptide encoding for HSU40434_PEA_1_P12 (SEQ ID NO: 226), comprising a first amino acid sequence being at least 90% homologous to MALPTARPLLGSCGTPALGSLLFLLFS-LGWVQPSRTLAGETGQEAAPLDGVLANPPNISS LSPRQLLGFPCAEVSGLSTERVRELAVA-LAQKNVKLSTEQLRCLAHRLSEPPEDLDALP LDLLL-FLNPDAFSGPQACTRFFSRITKANVDLL-PRGAPERQRLLPAALACWGVRGSLLS EADVRALGGLACDLPGRFVAESAEVLL-PRLVSCPGPLDQDQQEAARAALQGGGPPYGP PSTWSVSTMDALRGLLPVLGQPIIR-SIPQGIVAAWRQRSSRDPSWRQPERTILRPRFRRE VEKTACPSGKKAREIDESLIFYKKWE-LEACVDAALLATQMDRVNAIPFTYEQLDVLKH KLDELYPQGYPESVIQHLGYLFLKMS-PEDIRKWNVTSLETLKALLEVNKGHEMSPQVA TLIDRFVKGRGQLDKDTLDTL-TAFYPGYLCSLSPEELSSVPPSSIW corresponding to amino acids 1-458 of Q14859 (SEQ ID NO: 985), which also corresponds to amino acids 1-458 of HSU40434_PEA_1_P12 (SEQ ID NO: 226).

Comparison report between HSU40434_PEA_1_P12 (SEQ ID NO: 226) and Q9BTR2 (SEQ ID NO: 986) (SEQ ID NO:986):

1. An isolated chimeric polypeptide encoding for HSU40434_PEA_1_P12 (SEQ ID NO: 226), comprising a first amino acid sequence being at least 90% homologous to MALPTARPLLGSCGTPALGSLLFLLFS-LGWVQPSRTLAGETGQ corresponding to amino acids 1-43 of Q9BTR2 (SEQ ID NO: 986), which also corresponds to amino acids 1-43 of HSU40434_PEA_1_P12 (SEQ ID NO: 226), second amino acid sequence being at least 70%, optionally at least 80%, preferably at least 85%, more preferably at least 90% and most preferably at least 95% homologous to a polypeptide having the sequence E corresponding to amino acids 44-44 of HSU40434_PEA_1_P12 (SEQ ID NO: 226), and a third amino acid sequence being at least 90% homologous to AAPLDGVLANPPNISSLSPRQLLGFP-CAEVSGLSTERVRELAVALAQKNVKLSTEQLRC LAHRLSEPPEDLDALPLDLLLFLNPDAF-SGPQACTRFFSRITKANVDLLPRGAPERQRLL PAA-LACWGVRGSLLSEADVRALGGLA-CDLPGRFVAESAEVLLPRLVSCPGPLDQDQQE AARAALQGGGPPYGPPSTWSVSTMDALR-GLLPVLGQPIIRSIPQGIVAAWRQRSSRDPS WRQPER-TILRPRFRREVEKTACPSGKKAREIDES-LIFYKKWELEACVDAALLATQMDRV NAIPFTYEQLDVLKHKLDELYPQGYPES-VIQHLGYLFLKMSPEDIRKWNVTSLETLKAL LEVNKGHEMSPQVATLIDRFVKGRGQLD-KDTLDTLTAFYPGYLCSLSPEELSSVPPSSIW corresponding to amino acids 44-457 of Q9BTR2 (SEQ ID NO: 986), which also corresponds to amino acids 45-458 of HSU40434_PEA_1_P12 (SEQ ID NO: 226), wherein said first, second and third amino acid sequences are contiguous and in a sequential order.

2. An isolated polypeptide encoding for an edge portion of HSU40434_PEA_1_P12 (SEQ ID NO: 226), comprising an amino acid sequence being at least 70%, optionally at least about 80%, preferably at least about 85%, more preferably at least about 90% and most preferably at least about 95% homologous to the sequence encoding for E, corresponding to HSU40434_PEA_1_P12 (SEQ ID NO: 226).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSU40434_PEA_1_P12 (SEQ ID NO: 226) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein HSU40434_PEA_1_P12 (SEQ ID NO: 226) sequence provides support for the deduced sequence of this variant protein according to the present invention).

TABLE 6

| | Amino acid mutations | |
|---|---|---|
| SNP position(s) on amino acid sequence | Alternative amino acid(s) | Previously known SNP? |
| 118 | L -> V | No |
| 139 | R -> H | No |
| 162 | L -> Q | No |
| 235 | G -> | No |
| 330 | A -> V | No |
| 342 | I -> N | No |
| 402 | N -> D | No |
| 51 | V -> | No |

Variant protein HSU40434_PEA_1_P12 (SEQ ID NO: 226) is encoded by the following transcript(s): HSU40434_PEA_1_T13 (SEQ ID NO: 188), for which the sequence(s) is/are given at the end of the application. The coding portion of transcript HSU40434_PEA_1_T13 (SEQ ID NO: 188) is shown in bold; this coding portion starts at position 420 and ends at position 1793. The transcript also has the following SNPs as listed in Table 7 (given according to their position on the nucleotide sequence, with the alternative nucleic acid listed; the last column indicates whether the SNP is known or not; the presence of known SNPs in variant protein HSU40434_PEA_1_P12 (SEQ ID NO: 226) sequence provides support for the deduced sequence of this variant protein according to the present invention).

TABLE 7

Nucleic acid SNPs

| SNP position on nucleotide sequence | Alternative nucleic acid | Previously known SNP? |
|---|---|---|
| 170 | G -> A | Yes |
| 334 | G -> A | Yes |
| 1623 | A -> G | No |
| 1931 | G -> | No |
| 1955 | A -> G | No |
| 2270 | A -> G | No |
| 2352 | C -> | No |
| 2431 | G -> A | No |
| 2482 | C -> A | No |
| 2483 | C -> A | No |
| 557 | G -> A | No |
| 572 | C -> | No |
| 771 | C -> G | No |
| 835 | G -> A | No |
| 904 | T -> A | No |
| 1124 | C -> | No |
| 1408 | C -> T | No |
| 1444 | T -> A | No |

As noted above, cluster HSU40434 features 36 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSU40434_PEA_1_node_1 (SEQ ID NO: 189) according to the present invention is supported by 3 libraries. The number of libraries was determined as previously described. This segment can be found in the following transcript(s): HSU40434_PEA_1_T13 (SEQ ID NO: 188). Table 8 below describes the starting and ending position of this segment on each transcript.

TABLE 8

Segment location on transcripts

| Transcript name | Segment starting position | Segment ending position |
|---|---|---|
| HSU40434_PEA_1_T13 (SEQ ID NO:188) | 58 | 308 |

Segment cluster HSU40434_PEA_1_node_16 (SEQ ID NO: 190) according to the present invention is supported by 30 libraries. The number of libraries was determined as previously described. This segment can be found in the following transcript(s): HSU40434_PEA_1_T13 (SEQ ID NO: 188). Table 9 below describes the starting and ending position of this segment on each transcript.

TABLE 9

Segment location on transcripts

| Transcript name | Segment starting position | Segment ending position |
|---|---|---|
| HSU40434_PEA_1_T13 (SEQ ID NO:188) | 599 | 719 |

Segment cluster HSU40434_PEA_1_node_30 (SEQ ID NO: 191) according to the present invention is supported by 37 libraries. The number of libraries was determined as previously described. This segment can be found in the following transcript(s): HSU40434_PEA_1_T13 (SEQ ID NO: 188). Table 10 below describes the starting and ending position of this segment on each transcript.

TABLE 10

Segment location on transcripts

| Transcript name | Segment starting position | Segment ending position |
|---|---|---|
| HSU40434_PEA_1_T13 (SEQ ID NO:188) | 1315 | 1493 |

Segment cluster HSU40434_PEA_1_node_32 (SEQ ID NO: 192) according to the present invention is supported by 45 libraries. The number of libraries was determined as previously described. This segment can be found in the following transcript(s): HSU40434_PEA_1_T13 (SEQ ID NO: 188). Table 11 below describes the starting and ending position of this segment on each transcript.

TABLE 11

Segment location on transcripts

| Transcript name | Segment starting position | Segment ending position |
|---|---|---|
| HSU40434_PEA_1_T13 (SEQ ID NO:188) | 1494 | 1649 |

Segment cluster HSU40434_PEA_1_node_57 (SEQ ID NO: 193) according to the present invention is supported by 53 libraries. The number of libraries was determined as previously described. This segment can be found in the following transcript(s): HSU40434_PEA_1_T13 (SEQ ID NO: 188). Table 12 below describes the starting and ending position of this segment on each transcript.

TABLE 12

Segment location on transcripts

| Transcript name | Segment starting position | Segment ending position |
|---|---|---|
| HSU40434_PEA_1_T13 (SEQ ID NO:188) | 2307 | 2499 |

According to an optional embodiment of the present invention, short segments related to the above cluster are also provided. These segments are up to about 120 bp in length, and so are included in a separate description.

Segment cluster HSU40434_PEA_1_node_0 (SEQ ID NO: 194) according to the present invention is supported by 4 libraries. The number of libraries was determined as previously described. This segment can be found in the following transcript(s): HSU40434_PEA_1_T13 (SEQ ID NO: 188). Table 13 below describes the starting and ending position of this segment on each transcript.

TABLE 13

Segment location on transcripts

| Transcript name | Segment starting position | Segment ending position |
|---|---|---|
| HSU40434_PEA_1_T13 (SEQ ID NO:188) | 1 | 57 |

Segment cluster HSU40434_PEA_1_node_10 (SEQ ID NO: 195) according to the present invention is supported by 28 libraries. The number of libraries was determined as previously described. This segment can be found in the following transcript(s): HSU40434_PEA_1_T13 (SEQ ID NO: 188). Table 14 below describes the starting and ending position of this segment on each transcript.

TABLE 14

Segment location on transcripts

| Transcript name | Segment starting position | Segment ending position |
|---|---|---|
| HSU40434_PEA_1_T13 (SEQ ID NO:188) | 505 | 548 |

Segment cluster HSU40434_PEA_1_node_13 (SEQ ID NO: 196) according to the present invention is supported by 27 libraries. The number of libraries was determined as previously described. This segment can be found in the following transcript(s): HSU40434_PEA_1_T13 (SEQ ID NO: 188). Table 15 below describes the starting and ending position of this segment on each transcript.

TABLE 15

Segment location on transcripts

| Transcript name | Segment starting position | Segment ending position |
|---|---|---|
| HSU40434_PEA_1_T13 (SEQ ID NO:188) | 549 | 598 |

Segment cluster HSU40434_PEA_1_node_18 (SEQ ID NO: 197) according to the present invention is supported by 30 libraries. The number of libraries was determined as previously described. This segment can be found in the following transcript(s): HSU40434_PEA_1_T13 (SEQ ID NO: 188). Table 16 below describes the starting and ending position of this segment on each transcript.

TABLE 16

Segment location on transcripts

| Transcript name | Segment starting position | Segment ending position |
|---|---|---|
| HSU40434_PEA_1_T13 (SEQ ID NO:188) | 720 | 799 |

Segment cluster HSU40434_PEA_1_node_2 (SEQ ID NO: 198) according to the present invention is supported by 11 libraries. The number of libraries was determined as previously described. This segment can be found in the following transcript(s): HSU40434_PEA_1_T13 (SEQ ID NO: 188). Table 17 below describes the starting and ending position of this segment on each transcript.

TABLE 17

Segment location on transcripts

| Transcript name | Segment starting position | Segment ending position |
|---|---|---|
| HSU40434_PEA_1_T13 (SEQ ID NO:188) | 309 | 368 |

Segment cluster HSU40434_PEA_1_node_20 (SEQ ID NO: 199) according to the present invention is supported by 29 libraries. The number of libraries was determined as previously described. This segment can be found in the following transcript(s): HSU40434_PEA_1_T13 (SEQ ID NO: 188). Table 18 below describes the starting and ending position of this segment on each transcript.

TABLE 18

Segment location on transcripts

| Transcript name | Segment starting position | Segment ending position |
|---|---|---|
| HSU40434_PEA_1_T13 (SEQ ID NO:188) | 800 | 905 |

Segment cluster HSU40434_PEA_1_node_21 (SEQ ID NO: 200) according to the present invention can be found in the following transcript(s): HSU40434_PEA_1_T13 (SEQ ID NO: 188). Table 19 below describes the starting and ending position of this segment on each transcript.

TABLE 19

Segment location on transcripts

| Transcript name | Segment starting position | Segment ending position |
|---|---|---|
| HSU40434_PEA_1_T13 (SEQ ID NO:188) | 906 | 929 |

Segment cluster HSU40434_PEA_1_node_23 (SEQ ID NO: 201) according to the present invention is supported by 27 libraries. The number of libraries was determined as previously described. This segment can be found in the following transcript(s): HSU40434_PEA_1_T13 (SEQ ID NO: 188). Table 20 below describes the starting and ending position of this segment on each transcript.

TABLE 20

Segment location on transcripts

| Transcript name | Segment starting position | Segment ending position |
|---|---|---|
| HSU40434_PEA_1_T13 (SEQ ID NO:188) | 930 | 1043 |

Segment cluster HSU40434_PEA_1_node_24 (SEQ ID NO: 202) according to the present invention is supported by 26 libraries. The number of libraries was determined as previously described. This segment can be found in the following transcript(s): HSU40434_PEA_1_T13 (SEQ ID NO: 188).

Table 21 below describes the starting and ending position of this segment on each transcript.

TABLE 21

Segment location on transcripts

| Transcript name | Segment starting position | Segment ending position |
|---|---|---|
| HSU40434_PEA_1_T13 (SEQ ID NO:188) | 1044 | 1123 |

Segment cluster HSU40434_PEA_1_node_26 (SEQ ID NO: 203) according to the present invention is supported by 28 libraries. The number of libraries was determined as previously described. This segment can be found in the following transcript(s): HSU40434_PEA_1_T13 (SEQ ID NO: 188). Table 22 below describes the starting and ending position of this segment on each transcript.

TABLE 22

Segment location on transcripts

| Transcript name | Segment starting position | Segment ending position |
|---|---|---|
| HSU40434_PEA_1_T13 (SEQ ID NO:188) | 1124 | 1214 |

Segment cluster HSU40434_PEA_1_node_28 (SEQ ID NO: 204) according to the present invention is supported by 30 libraries. The number of libraries was determined as previously described. This segment can be found in the following transcript(s): HSU40434_PEA_1_T13 (SEQ ID NO: 188). Table 23 below describes the starting and ending position of this segment on each transcript.

TABLE 23

Segment location on transcripts

| Transcript name | Segment starting position | Segment ending position |
|---|---|---|
| HSU40434_PEA_1_T13 (SEQ ID NO:188) | 1215 | 1314 |

Segment cluster HSU40434_PEA_1_node_3 (SEQ ID NO: 205) according to the present invention is supported by 19 libraries. The number of libraries was determined as previously described. This segment can be found in the following transcript(s): HSU40434_PEA_1_T13 (SEQ ID NO: 188). Table 24 below describes the starting and ending position of this segment on each transcript.

TABLE 24

Segment location on transcripts

| Transcript name | Segment starting position | Segment ending position |
|---|---|---|
| HSU40434_PEA_1_T13 (SEQ ID NO:188) | 369 | 410 |

Segment cluster HSU40434_PEA_1_node_35 (SEQ ID NO: 206) according to the present invention is supported by 43 libraries. The number of libraries was determined as previously described. This segment can be found in the following transcript(s): HSU40434_PEA_1_T13 (SEQ ID NO: 188). Table 25 below describes the starting and ending position of this segment on each transcript.

TABLE 25

Segment location on transcripts

| Transcript name | Segment starting position | Segment ending position |
|---|---|---|
| HSU40434_PEA_1_T13 (SEQ ID NO:188) | 1650 | 1679 |

Segment cluster HSU40434_PEA_1_node_36 (SEQ ID NO: 207) according to the present invention is supported by 51 libraries. The number of libraries was determined as previously described. This segment can be found in the following transcript(s): HSU40434_PEA_1_T13 (SEQ ID NO: 188). Table 26 below describes the starting and ending position of this segment on each transcript.

TABLE 26

Segment location on transcripts

| Transcript name | Segment starting position | Segment ending position |
|---|---|---|
| HSU40434_PEA_1_T13 (SEQ ID NO:188) | 1680 | 1753 |

Segment cluster HSU40434_PEA_1_node_37 (SEQ ID NO: 208) according to the present invention is supported by 48 libraries. The number of libraries was determined as previously described. This segment can be found in the following transcript(s): HSU40434_PEA_1_T13 (SEQ ID NO: 188). Table 27 below describes the starting and ending position of this segment on each transcript.

TABLE 27

Segment location on transcripts

| Transcript name | Segment starting position | Segment ending position |
|---|---|---|
| HSU40434_PEA_1_T13 (SEQ ID NO:188) | 1754 | 1792 |

Segment cluster HSU40434_PEA_1_node_38 (SEQ ID NO: 209) according to the present invention is supported by 1 libraries. The number of libraries was determined as previously described. This segment can be found in the following transcript(s): HSU40434_PEA_1_T13 (SEQ ID NO: 188). Table 28 below describes the starting and ending position of this segment on each transcript.

TABLE 28

Segment location on transcripts

| Transcript name | Segment starting position | Segment ending position |
|---|---|---|
| HSU40434_PEA_1_T13 (SEQ ID NO:188) | 1793 | 1866 |

Segment cluster HSU40434_PEA_1_node_39 (SEQ ID NO: 210) according to the present invention is supported by 46 libraries. The number of libraries was determined as previously described. This segment can be found in the following transcript(s): HSU40434_PEA_1_T13 (SEQ ID NO: 188). Table 29 below describes the starting and ending position of this segment on each transcript.

TABLE 29

Segment location on transcripts

| Transcript name | Segment starting position | Segment ending position |
|---|---|---|
| HSU40434_PEA_1_T13 (SEQ ID NO:188) | 1867 | 1909 |

Segment cluster HSU40434_PEA_1_node_40 (SEQ ID NO: 211) according to the present invention can be found in the following transcript(s): HSU40434_PEA_1_T13 (SEQ ID NO: 188). Table 30 below describes the starting and ending position of this segment on each transcript.

TABLE 30

Segment location on transcripts

| Transcript name | Segment starting position | Segment ending position |
|---|---|---|
| HSU40434_PEA_1_T13 (SEQ ID NO:188) | 1910 | 1930 |

Segment cluster HSU40434_PEA_1_node_41 (SEQ ID NO: 212) according to the present invention can be found in the following transcript(s): HSU40434_PEA_1_T13 (SEQ ID NO: 188). Table 31 below describes the starting and ending position of this segment on each transcript.

TABLE 31

Segment location on transcripts

| Transcript name | Segment starting position | Segment ending position |
|---|---|---|
| HSU40434_PEA_1_T13 (SEQ ID NO:188) | 1931 | 1948 |

Segment cluster HSU40434_PEA_1_node_42 (SEQ ID NO: 213) according to the present invention can be found in the following transcript(s): HSU40434_PEA_1_T13 (SEQ ID NO: 188). Table 32 below describes the starting and ending position of this segment on each transcript.

TABLE 32

Segment location on transcripts

| Transcript name | Segment starting position | Segment ending position |
|---|---|---|
| HSU40434_PEA_1_T13 (SEQ ID NO:188) | 1949 | 1972 |

Segment cluster HSU40434_PEA_1_node_43 (SEQ ID NO: 214) according to the present invention can be found in the following transcript(s): HSU40434_PEA_1_T13 (SEQ ID NO: 188). Table 33 below describes the starting and ending position of this segment on each transcript.

TABLE 33

Segment location on transcripts

| Transcript name | Segment starting position | Segment ending position |
|---|---|---|
| HSU40434_PEA_1_T13 (SEQ ID NO:188) | 1973 | 1990 |

Segment cluster HSU40434_PEA_1_node_44 (SEQ ID NO: 215) according to the present invention can be found in the following transcript(s): HSU40434_PEA_1_T13 (SEQ ID NO: 188). Table 34 below describes the starting and ending position of this segment on each transcript.

TABLE 34

Segment location on transcripts

| Transcript name | Segment starting position | Segment ending position |
|---|---|---|
| HSU40434_PEA 1_T13 (SEQ ID NO:188) | 1991 | 1994 |

Segment cluster HSU40434_PEA_1_node_47 (SEQ ID NO: 216) according to the present invention is supported by 49 libraries. The number of libraries was determined as previously described. This segment can be found in the following transcript(s): HSU40434_PEA_1_T13 (SEQ ID NO: 188). Table 35 below describes the starting and ending position of this segment on each transcript.

TABLE 35

Segment location on transcripts

| Transcript name | Segment starting position | Segment ending position |
|---|---|---|
| HSU40434_PEA_1_T13 (SEQ ID NO:188) | 1995 | 2032 |

Segment cluster HSU40434_PEA_1_node_48 (SEQ ID NO: 217) according to the present invention is supported by 50 libraries. The number of libraries was determined as previously described. This segment can be found in the following transcript(s): HSU40434_PEA_1_T13 (SEQ ID NO: 188). Table 36 below describes the starting and ending position of this segment on each transcript.

TABLE 36

Segment location on transcripts

| Transcript name | Segment starting position | Segment ending position |
|---|---|---|
| HSU40434_PEA_1_T13 (SEQ ID NO:188) | 2033 | 2089 |

Segment cluster HSU40434_PEA_1_node_51 (SEQ ID NO: 218) according to the present invention can be found in the following transcript(s): HSU40434_PEA_1_T13 (SEQ ID NO: 188). Table 37 below describes the starting and ending position of this segment on each transcript.

TABLE 37

Segment location on transcripts

| Transcript name | Segment starting position | Segment ending position |
|---|---|---|
| HSU40434_PEA_1_T13 (SEQ ID NO:188) | 2090 | 2113 |

Segment cluster HSU40434_PEA_1_node_52 (SEQ ID NO: 219) according to the present invention is supported by 52 libraries. The number of libraries was determined as previously described. This segment can be found in the following transcript(s): HSU40434_PEA_1_T13 (SEQ ID NO: 188). Table 38 below describes the starting and ending position of this segment on each transcript.

TABLE 38

Segment location on transcripts

| Transcript name | Segment starting position | Segment ending position |
|---|---|---|
| HSU40434_PEA_1_T13 (SEQ ID NO:188) | 2114 | 2140 |

Segment cluster HSU40434_PEA_1_node_53 (SEQ ID NO: 220) according to the present invention is supported by 58 libraries. The number of libraries was determined as previously described. This segment can be found in the following transcript(s): HSU40434_PEA_1_T13 (SEQ ID NO: 188). Table 39 below describes the starting and ending position of this segment on each transcript.

TABLE 39

Segment location on transcripts

| Transcript name | Segment starting position | Segment ending position |
|---|---|---|
| HSU40434_PEA_1_T13 (SEQ ID NO:188) | 2141 | 2197 |

Segment cluster HSU40434_PEA_1_node_54 (SEQ ID NO: 221) according to the present invention is supported by 56 libraries. The number of libraries was determined as previously described. This segment can be found in the following transcript(s): HSU40434_PEA_1_T13 (SEQ ID NO: 188). Table 40 below describes the starting and ending position of this segment on each transcript.

TABLE 40

Segment location on transcripts

| Transcript name | Segment starting position | Segment ending position |
|---|---|---|
| HSU40434_PEA_1_T13 (SEQ ID NO:188) | 2198 | 2276 |

Segment cluster HSU40434_PEA_1_node_56 (SEQ ID NO: 222) according to the present invention is supported by 49 libraries. The number of libraries was determined as previously described. This segment can be found in the following transcript(s): HSU40434_PEA_1_T13 (SEQ ID NO: 188). Table 41 below describes the starting and ending position of this segment on each transcript.

TABLE 41

Segment location on transcripts

| Transcript name | Segment starting position | Segment ending position |
|---|---|---|
| HSU40434_PEA_1_T13 (SEQ ID NO:188) | 2277 | 2306 |

Segment cluster HSU40434_PEA_1_node_7 (SEQ ID NO: 223) according to the present invention is supported by 29 libraries. The number of libraries was determined as previously described. This segment can be found in the following transcript(s): HSU40434_PEA_1_T13 (SEQ ID NO: 188). Table 42 below describes the starting and ending position of this segment on each transcript.

TABLE 42

Segment location on transcripts

| Transcript name | Segment starting position | Segment ending position |
|---|---|---|
| HSU40434_PEA_1_T13 (SEQ ID NO:188) | 411 | 464 |

Segment cluster HSU40434_PEA_1_node_8 (SEQ ID NO: 224) according to the present invention is supported by 28 libraries. The number of libraries was determined as previously described. This segment can be found in the following transcript(s): HSU40434_PEA_1_T13 (SEQ ID NO: 188). Table 43 below describes the starting and ending position of this segment on each transcript.

TABLE 43

Segment location on transcripts

| Transcript name | Segment starting position | Segment ending position |
|---|---|---|
| H5U40434_PEA_1_T13 (SEQ ID NO:188) | 465 | 504 |

Variant protein alignment to the previously known protein:

Sequence name: /tmp/tZTolp1A91/eTMhjqGV2R:Q14859 (SEQ ID NO: 985)

Sequence documentation:

Alignment of: HSU40434_PEA_1_P12 (SEQ ID NO: 226) x Q14859 (SEQ ID NO: 985) . . .

Alignment segment 1/1:
  Quality: 4448.00

Escore: 0
  Matching length: 458 Total length: 458

Matching Percent Similarity: 100.00 Matching Percent Identity: 100.00
  Total Percent Similarity: 100.00 Total Percent Identity: 100.00
  Gaps: 0

Alignment:

```
  1 MALPTARPLLGSCGTPALGSLLFLLFSLGWVQPSRTLAGETGQEAAPLDG   50
    ||||||||||||||||||||||||||||||||||||||||||||||||||
  1 MALPTARPLLGSCGTPALGSLLFLLFSLGWVQPSRTLAGETGQEAAPLDG   50

51 VLANPPNISSLSPRQLLGFPCAEVSGLSTERVRELAVALAQKNVKLSTEQ  100
    ||||||||||||||||||||||||||||||||||||||||||||||||||
 51 VLANPPNISSLSPRQLLGFPCAEVSGLSTERVRELAVALAQKNVKLSTEQ  100

101 LRCLAHRLSEPPEDLDALPLDLLLFLNPDAFSGPQACTRFFSRITKANVD  150
    ||||||||||||||||||||||||||||||||||||||||||||||||||
101 LRCLAHRLSEPPEDLDALPLDLLLFLNPDAFSGPQACTRFFSRITKANVD  150

151 LLPRGAPERQRLLPAALACWGVRGSLLSEADVRALGGLACDLPGRFVAES  200
    ||||||||||||||||||||||||||||||||||||||||||||||||||
151 LLPRGAPERQRLLPAALACWGVRGSLLSEADVRALGGLACDLPGRFVAES  200

201 AEVLLPRLVSCPGPLDQDQQEAARAALQGGGPPYGPPSTWSVSTMDALRG  250
    ||||||||||||||||||||||||||||||||||||||||||||||||||
201 AEVLLPRLVSCPGPLDQDQQEAARAALQGGGPPYGPPSTWSVSTMDALRG  250

251 LLPVLGQPIIRSIPQGIVAAWRQRSSRDPSWRQPERTILRPRFRREVEKT  300
    ||||||||||||||||||||||||||||||||||||||||||||||||||
251 LLPVLGQPIIRSIPQGIVAAWRQRSSRDPSWRQPERTILRPRFRREVEKT  300

301 ACPSGKKAREIDESLIFYKKWELEACVDAALLATQMDRVNAIPFTYEQLD  350
    ||||||||||||||||||||||||||||||||||||||||||||||||||
301 ACPSGKKAREIDESLIFYKKWELEACVDAALLATQMDRVNAIPFTYEQLD  350

351 VLKHKLDELYPQGYPESVIQHLGYLFLKMSPEDIRKWNVTSLETLKALLE  400
    ||||||||||||||||||||||||||||||||||||||||||||||||||
351 VLKHKLDELYPQGYPESVIQHLGYLFLKMSPEDIRKWNVTSLETLKALLE  400

401 VNKGHEMSPQVATLIDRFVKGRGQLDKDTLDTLTAFYPGYLCSLSPEELS  450
    ||||||||||||||||||||||||||||||||||||||||||||||||||
401 VNKGHEMSPQVATLIDRFVKGRGQLDKDTLDTLTAFYPGYLCSLSPEELS  450
451 SVPPSSIW                                            458
    ||||||||
451 SVPPSSIW                                            458
```

Sequence name: /tmp/tZTolp1A91/eTMhjqGV2R:Q9BTR2 (SEQ ID NO: 986)

Sequence documentation:

Alignment of: HSU40434_PEA_1_P12 (SEQ ID NO: 226) x Q9BTR2 (SEQ ID NO: 986) . . .

Alignment segment 1/1:
  Quality: 4338.00

Escore: 0
  Matching length: 457 Total length: 458

Matching Percent Similarity: 100.00 Matching Percent Identity: 100.00
  Total Percent Similarity: 99.78 Total Percent Identity: 99.78
  Gaps: 1

Alignment:

```
  1 MALPTARPLLGSCGTPALGSLLFLLFSLGWVQPSRTLAGETGQEAAPLDG   50
    |||||||||||||||||||||||||||||||||||||||||| |||||||
  1 MALPTARPLLGSCGTPALGSLLFLLFSLGWVQPSRTLAGETGQ.AAPLDG   49

51 VLANPPNISSLSPRQLLGFPCAEVSGLSTERVRELAVALAQKNVKLSTEQ  100
    ||||||||||||||||||||||||||||||||||||||||||||||||||
 50 VLANPPNISSLSPRQLLGFPCAEVSGLSTERVRELAVALAQKNVKLSTEQ   99

101 LRCLAHRLSEPPEDLDALPLDLLLFLNPDAFSGPQACTRFFSRITKANVD  150
    ||||||||||||||||||||||||||||||||||||||||||||||||||
100 LRCLAHRLSEPPEDLDALPLDLLLFLNPDAFSGPQACTRFFSRITKANVD  149

151 LLPRGAPERQRLLPAALACWGVRGSLLSEADVRALGGLACDLPGRFVAES  200
    ||||||||||||||||||||||||||||||||||||||||||||||||||
150 LLPRGAPERQRLLPAALACWGVRGSLLSEADVRALGGLACDLPGRFVAES  199

201 AEVLLPRLVSCPGPLDQDQQEAARAALQGGGPPYGPPSTWSVSTMDALRG  250
    ||||||||||||||||||||||||||||||||||||||||||||||||||
200 AEVLLPRLVSCPGPLDQDQQEAARAALQGGGPPYGPPSTWSVSTMDALRG  249
```

-continued

```
251  LLPVLGQPIIRSIPQGIVAAWRQRSSRDPSWRQPERTILRPRFRREVEKT  300
     ||||||||||||||||||||||||||||||||||||||||||||||||||
250  LLPVLGQPIIRSIPQGIVAAWRQRSSRDPSWRQPERTILRPRFRREVEKT  299

301  ACPSGKKAREIDESLIFYKKWELEACVDAALLATQMDRVNAIPFTYEQLD  350
     ||||||||||||||||||||||||||||||||||||||||||||||||||
300  ACPSGKKAREIDESLIFYKKWELEACVDAALLATQMDRVNAIPFTYEQLD  349

351  VLKHKLDELYPQGYPESVIQHLGYLFLKMSPEDIRKWNVTSLETLKALLE  400
     ||||||||||||||||||||||||||||||||||||||||||||||||||
350  VLKHKLDELYPQGYPESVIQHLGYLFLKMSPEDIRKWNVTSLETLKALLE  399

401  VNKGHEMSPQVATLIDRFVKGRGQLDKDTLDTLTAFYPGYLCSLSPEELS  450
     ||||||||||||||||||||||||||||||||||||||||||||||||||
400  VNKGHEMSPQVATLIDRFVKGRGQLDKDTLDTLTAFYPGYLCSLSPEELS  449

451  SVPPSSIW  458
     ||||||||
450  SVPPSSIW  457
```

Sequence name: /tmp/tZTolp1A91/eTMhjqGV2R:MSLN_HUMAN

Sequence documentation:

Alignment of: HSU40434_PEA_1_P12 (SEQ ID NO: 226) x MSLN_HUMAN ...

Identity: 97.95

Total Percent Similarity: 97.10 Total Percent Identity: 96.21

Gaps: 1

Alignment:

```
 19  GSLLFLLFSLGWVQPSRTLAGETGQEAAPLDGVLANPPNISSLSPRQLLG   68
     ||||||||||||||:|:|||||||||  |:|||  |||  ||||||||||
 17  GSLLFLLFSLGWVQPSRTLAGETGQEAAPLDGVLANPPNISSLSPRQLLG   66

69  FPCAEVSGLSTERVRELAVALAQKNVKLSTEQLRCLAHRLSEPPEDLDAL  118
     ||||||||||||||||||||||||||||||||||||||||||||||||||
 67  FPCAEVSGLSTERVRELAVALAQKNVKLSTEQLRCLAHRLSEPPEDLDAL  116

119  PLDLLLFLNPDAFSGPQACTRFFSRITKANVDLLPRGAPERQRLLPAALA  168
     ||||||||||||||||||||||||||||||||||||||||||||||||||
117  PLDLLLFLNPDAFSGPQACTRFFSRITKANVDLLPRGAPERQRLLPAALA  166

169  CWGVRGSLLSEADVRALGGLACDLPGRFVAESAEVLLPRLVSCPGPLDQD  218
     ||||||||||||||||||||||||||||||||||||||||||||||||||
167  CWGVRGSLLSEADVRALGGLACDLPGRFVAESAEVLLPRLVSCPGPLDQD  216

219  QQEAARAALQGGGPPYGPPSTWSVSTMDALRGLLPVLGQPIIRSIPQGIV  268
     ||||||||||||||||||||||||||||||||||||||||||||||||||
217  QQEAARAALQGGGPPYGPPSTWSVSTMDALRGLLPVLGQPIIRSIPQGIV  266

269  AAWRQRSSRDPSWRQPERTILRPRFRREVEKTACPSGKKAREIDESLIFY  318
     ||||||||||||||||||||||||||||||||||||||||||||||||||
267  AAWRQRSSRDPSWRQPERTILRPRFRREVEKTACPSGKKAREIDESLIFY  316

319  KKWELEACVDAALLATQMDRVNAIPFTYEQLDVLKHKLDELYPQGYPESV  368
     ||||||||||||||||||||||||||||||||||||||||||||||||||
317  KKWELEACVDAALLATQMDRVNAIPFTYEQLDVLKHKLDELYPQGYPESV  366

369  IQHLGYLFLKMSPEDIRKWNVTSLETLKALLEVNKGHEMS........PQ  410
     |||||||||||||||||||||||||||||||||||||||:||||||  ||
367  IQHLGYLFLKMSPEDIRKWNVTSLETLKALLEVNKGHEMSPQAPRRPLPQ  416

411  VATLIDRFVKGRGQLDKDTLDTLTAFYPGYLCSLSPEELSSVPPSSIW   458
     |||||||||||||||||||||||||||||||||||||||||||||||
417  VATLIDRFVKGRGQLDKDTLDTLTAFYPGYLCSLSPEELSSVPPSSIW   464
```

Alignment segment 1/1:
  Quality: 4074.00

Escore: 0
  Matching length: 440 Total length: 448

Matching Percent Similarity: 98.86 Matching Percent

DESCRIPTION FOR CLUSTER M77904

Cluster M77904 features 4 transcript(s) and 21 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| M77904_T11 | 227 |
| M77904_T3 | 228 |
| M77904_T8 | 229 |
| M77904_T9 | 230 |

TABLE 2

Segments of interest

| Segment Name | SEQ ID NO: |
|---|---|
| M77904_node_0 | 231 |
| M77904_node_11 | 232 |
| M77904_node_12 | 233 |
| M77904_node_14 | 234 |
| M77904_node_15 | 235 |
| M77904_node_17 | 236 |
| M77904_node_2 | 237 |
| M77904_node_21 | 238 |
| M77904_node_23 | 239 |
| M77904_node_24 | 240 |
| M77904_node_27 | 241 |
| M77904_node_28 | 242 |
| M77904_node_4 | 243 |
| M77904_node_6 | 244 |
| M77904_node_7 | 245 |
| M77904_node_8 | 246 |
| M77904_node_9 | 247 |
| M77904_node_19 | 248 |
| M77904_node_22 | 249 |
| M77904_node_25 | 250 |
| M77904_node_26 | 251 |

TABLE 3

Proteins of interest

| Protein Name | SEQ ID NO: |
|---|---|
| M77904_P2 | 252 |
| M77904_P4 | 253 |
| M77904_P5 | 254 |
| M77904_P7 | 255 |

Cluster M77904 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 24 refer to weighted expression of ESTs in each category, as "parts per million" (ratio of the expression of ESTs for a particular cluster to the expression of all ESTs in that category, according to parts per million).

Figure 24:
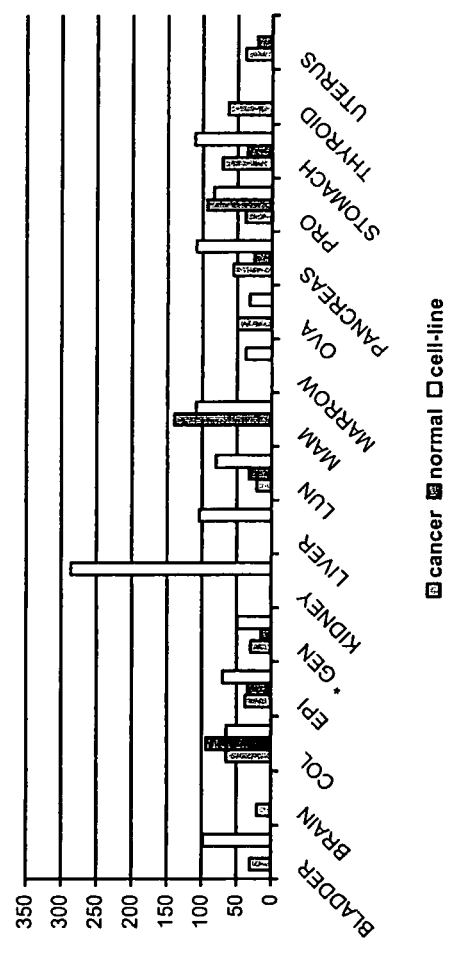
FIG. 24 shows cancer and cell-line vs. normal tissue expression.

Overall, the following results were obtained as shown with regard to the histograms in FIG. 24 and Table 4. This cluster is overexpressed (at least at a minimum level) in the following pathological conditions: a mixture of malignant tumors from different tissues.

TABLE 4

Normal tissue distribution

| Name of Tissue | Number |
|---|---|
| bladder | 0 |
| brain | 0 |
| colon | 94 |
| epithelial | 35 |
| general | 15 |
| kidney | 0 |
| liver | 0 |
| lung | 33 |
| breast | 140 |
| bone marrow | 0 |
| ovary | 0 |
| pancreas | 26 |
| prostate | 94 |
| stomach | 36 |
| Thyroid | 0 |
| uterus | 22 |

TABLE 5

P values and ratios for expression in cancerous tissue

| Name of Tissue | P1 | P2 | SP1 | R3 | SP2 | R4 |
|---|---|---|---|---|---|---|
| bladder | 5.4e−01 | 3.4e−01 | 5.6e−01 | 1.8 | 3.2e−01 | 2.4 |
| brain | 8.8e−02 | 1.3e−01 | 4.8e−02 | 8.1 | 1.1e−01 | 5.1 |
| colon | 3.8e−01 | 3.8e−01 | 8.7e−01 | 0.8 | 8.2e−01 | 0.8 |
| epithelial | 3.1e−02 | 1.5e−02 | 4.9e−01 | 1.1 | 3.9e−02 | 1.4 |
| general | 2.0e−04 | 3.4e−05 | 4.1e−03 | 2.0 | 6.2e−07 | 2.5 |
| kidney | 6.5e−01 | 3.5e−01 | 1 | 1.1 | 1.4e−02 | 4.0 |
| liver | 1 | 3.0e−01 | 1 | 1.0 | 2.3e−01 | 2.0 |
| lung | 5.9e−01 | 4.8e−01 | 8.8e−01 | 0.7 | 3.4e−01 | 1.2 |
| breast | 8.7e−01 | 8.8e−01 | 1 | 0.2 | 9.4e−01 | 0.3 |
| bone marrow | 1 | 4.2e−01 | 1 | 1.0 | 5.3e−01 | 2.1 |
| ovary | 1.3e−01 | 9.4e−02 | 3.2e−01 | 2.4 | 3.4e−01 | 2.2 |
| pancreas | 5.1e−01 | 5.2e−01 | 2.1e−01 | 1.8 | 7.6e−02 | 1.8 |
| prostate | 8.6e−01 | 8.0e−01 | 9.2e−01 | 0.5 | 8.4e−01 | 0.6 |
| stomach | 2.7e−01 | 1.9e−01 | 5.0e−01 | 1.5 | 2.7e−01 | 1.8 |
| Thyroid | 6.4e−01 | 6.4e−01 | 6.7e−01 | 1.5 | 6.7e−01 | 1.5 |
| uterus | 1.2e−01 | 3.4e−01 | 5.9e−01 | 1.4 | 8.2e−01 | 0.9 |

As noted above, cluster M77904 features 4 transcript(s), which were listed in Table 1 above. A description of each variant protein according to the present invention is now provided.

Variant protein M77904_P2 (SEQ ID NO: 252) according to the present invention has an amino acid sequence as given at the end of the application; it is encoded by transcript(s) M77904_T3 (SEQ ID NO: 228). One or more alignments to one or more previously published protein sequences are given at the end of the application. A brief description of the relationship of the variant protein according to the present invention to each such aligned protein is as follows:

Comparison report between M77904_P2 (SEQ ID NO: 252) and Q8WU91 (SEQ ID NO: 987) (SEQ ID NO:987):

1. An isolated chimeric polypeptide encoding for M77904_P2 (SEQ ID NO: 252), comprising a first amino acid sequence being at least 90% homologous to MLSIKS-GERIVFTFSCQSPENHFVIEIQKNIDC-MSGPCPFGEVQLQPSTSLLPTLNRTFIWD VKAHKSI-GLELQFSIPRLRQIGPGESCPDGVTHSISGRIDATVVRI GTFCSNGTVSRIKMQ EGVKMALHLPWFHPRNVSGF-SIANRSSIKRLCIIESVFEGEGSATLM-SANYPEGFPEDEL MTWQFVVPAHLRASVSFLNFNL-SNCERKEERVEYYIPGSTTNPEVFKLEDKQPGNMAG NFNLSLQGCDQDAQSPGILRLQFQVLVQHPQNES corresponding to amino acids 67-341 of Q8WU91 (SEQ ID NO:

987), which also corresponds to amino acids 1-275 of M77904_P2 (SEQ ID NO: 252), and a second amino acid sequence being at least 70%, optionally at least 80%, preferably at least 85%, more preferably at least 90% and most preferably at least 95% homologous to a polypeptide having the sequence NKIYVVDLSNERAMSLTIEPRPVKQSRK-FVPGCFVCLESRTCSSNLTLTSGSKHKISFLCD DLTRL-WMNVEKTISCTDHRYCQRKSYSLQVPS-DILHLPVELHDFSWKLLVPKDRLSLVL VPAQKLQQHTHEKPCNTSFSYLVA-SAIPSQDLYFGSFCPGGSIKQIQVKQNISVTLRTFAP SFQQEASRQGLTVSFIPYFKEEGVFTVT-PDTKSKVYLRTPNWDRGLPSLTSVSWNISVPR DQVA-CLTFFKERSGVVCQTGRAFMIIQEQR-TRAEEIFSLDEDVLPKPSFHHHSFWVNISN CSPTSGKQLDLLFSVTLTPRTVDLTVIL-IAAVGGGVLLLSALGLIICCVKKKKKKTNKGP AVGIYNGNINTEMPRQPKKFQKGRKDND-SHVYAVIEDTMVYGHLLQDSSGSFLQPEVD TYR-PFQGTMGVCPPSPPTICSRAPTAKLA-TEEPPPRSPPESESEPYTFSHPNNGDVSSKDT DIPLLNTQEPMEPAE (SEQ ID NO: 1135) corresponding to amino acids 276-770 of M77904_P2 (SEQ ID NO: 252), wherein said first and second amino acid sequences are contiguous and in a sequential order.

2. An isolated polypeptide encoding for a tail of M77904_P2 (SEQ ID NO: 252), comprising a polypeptide being at least 70%, optionally at least about 80%, preferably at least about 85%, more preferably at least about 90% and most preferably at least about 95% homologous to the sequence NKIYVVDLSNERAMSLTIEPRPVKQSRK-FVPGCFVCLESRTCSSNLTLTSGSKHKISFLCD DLTRL-WMNVEKTISCTDHRYCQRKSYSLQVPS-DILHLPVELHDFSWKLLVPKDRLSLVL VPAQKLQQHTHEKPCNTSFSYLVA-SAIPSQDLYFGSFCPGGSIKQIQVKQNISVTLRTFAP SFQQEASRQGLTVSFIPYFKEEGVFTVT-PDTKSKVYLRTPNWDRGLPSLTSVSWNISVPR DQVA-CLTFFKERSGVVCQTGRAFMIIQEQR-TRAEEIFSLDEDVLPKPSFHHHSFWVNISN CSPTSGKQLDLLFSVTLTPRTVDLTVIL-IAAVGGGVLLLSALGLIICCVKKKKKKTNKGP AVGIYNGNINTEMPRQPKKFQKGRKDND-SHVYAVIEDTMVYGHLLQDSSGSFLQPEVD TYR-PFQGTMGVCPPSPPTICSRAPTAKLA-TEEPPPRSPPESESEPYTFSHPNNGDVSSKDT DIPLLNTQEPMEPAE (SEQ ID NO: 1135) in M77904_P2 (SEQ ID NO: 252).

Comparison report between M77904_P2 (SEQ ID NO: 252) and Q96QU7 (SEQ ID NO: 988) (SEQ ID NO:988):

1. An isolated chimeric polypeptide encoding for M77904_P2 (SEQ ID NO: 252), comprising a first amino acid sequence being at least 90% homologous to MLSIKS-GERIVFTFSCQSPENHFVIEIQKNIDC-MSGPCPFGEVQLQPSTSLLPTLNRTFIWD VKAHKSI-GLELQFSIPRLRQIGPGESCPDGVTHSISGRIDATVVR IGTFCSNGTVSRIKMQ EGVKMALHLPWFHPRNVSG-FSIANRSSIKRLCIIESVFEGEGSATLM-SANYPEGFPEDEL MTWQFVVPAHLRASVSFLNFNL-SNCERKEERVEYYIPGSTTNPEVFKLEDKQPGNMAG NFNLSLQGCDQDAQSPGILRLQFQV-LVQHPQNESNKIYVVDLSNERAMSLTIEPRPVKQ SRKFVPGCFVCLESRTCSSNLTLTSG-SKHKISFLCDDLTRLWMNVEKTISCTDHRYCQR KSYSLQVPSDILHLPVELHDFSWKLLVP-KDRLSLVLVPAQKLQQHTHEKPCNTSFSYLV ASAIPSQDLYFGSFCPGGSIK-QIQVKQNISVTLRTFAPSFQQEAS-RQGLTVSFIPYFKEEGV FTVTPDTKSKVYLRTPN-WDRGLPSLTSVSWNISVPRDQVACLTFFKERSGVVC QTGRAF MIIQEQRTRAEEIFSLDEDVLPKPSFH-HHSFWVNISNCSPTSGKQLDLLFSVTLTPRTVDL TVILIAAVGGGVLLLSALGLIIC-CVKKKKKKTNKGPAVGIYNGNINTEM-PRQPKKFQKG RKDNDSHVYAVIEDTM-VYGHLLQDSSGSFLQPEVDTYRPFQGTMGVCPPSPP TICSRAP TAKLATEEPPPRSPPESESEPYTFSHPN-NGDVSSKDTDIPLLNTQEPMEPAE (SEQ ID NO: 1135) corresponding to amino acids 67-836 of Q96QU7 (SEQ ID NO: 988), which also corresponds to amino acids 1-770 of M77904_P2 (SEQ ID NO: 252).

The location of the variant protein was determined according to results from a number of different software programs and analyses, including analyses from SignalP and other specialized programs. The variant protein is believed to be located as follows with regard to the cell: membrane. The protein localization is believed to be membrane because both trans-membrane region prediction programs predicted a trans-membrane region for this protein. In addition both signal-peptide prediction programs predict that this protein is a non-secreted protein.

Variant protein M77904_P2 (SEQ ID NO: 252) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein M77904_P2 (SEQ ID NO: 252) sequence provides support for the deduced sequence of this variant protein according to the present invention).

TABLE 6

Amino acid mutations

| SNP position(s) on amino acid sequence | Alternative amino acid(s) | Previously known SNP? |
| --- | --- | --- |
| 263 | Q -> R | No |
| 459 | Q -> R | Yes |
| 643 | G -> D | Yes |

Variant protein M77904_P2 (SEQ ID NO: 252) is encoded by the following transcript(s): M77904_T3 (SEQ ID NO: 228), for which the sequence(s) is/are given at the end of the application. The coding portion of transcript M77904_T3 (SEQ ID NO: 228) is shown in bold; this coding portion starts at position 238 and ends at position 2547. The transcript also has the following SNPs as listed in Table 7 (given according to their position on the nucleotide sequence, with the alternative nucleic acid listed; the last column indicates whether the SNP is known or not; the presence of known SNPs in variant protein M77904_P2 (SEQ ID NO: 252) sequence provides support for the deduced sequence of this variant protein according to the present invention).

TABLE 7

Nucleic acid SNPs

| SNP position on nucleotide sequence | Alternative nucleic acid | Previously known SNP? |
| --- | --- | --- |
| 561 | C -> T | No |
| 585 | T -> C | No |
| 3276 | T -> G | Yes |

TABLE 7-continued

Nucleic acid SNPs

| SNP position on nucleotide sequence | Alternative nucleic acid | Previously known SNP? |
|---|---|---|
| 3465 | C -> T | Yes |
| 3760 | A -> T | Yes |
| 3830 | G -> A | Yes |
| 3900 | A -> G | Yes |
| 3960 | C -> A | Yes |
| 4114 | G -> A | Yes |
| 4613 | C -> T | Yes |
| 5050 | G -> A | No |
| 5309 | A -> C | Yes |
| 957 | G -> A | Yes |
| 5329 | A -> G | Yes |
| 5420 | T -> C | Yes |
| 5490 | T -> C | Yes |
| 5507 | C -> A | Yes |
| 5511 | G -> A | Yes |
| 5578 | T -> G | Yes |
| 5662 | A -> C | No |
| 1025 | A -> G | No |
| 1613 | A -> G | Yes |
| 1623 | C -> T | Yes |
| 2085 | T -> C | No |
| 2165 | G -> A | Yes |
| 3043 | T -> C | No |
| 3122 | G -> A | Yes |

Variant protein M77904_P4 (SEQ ID NO: 253) according to the present invention has an amino acid sequence as given at the end of the application; it is encoded by transcript(s) M77904_T8 (SEQ ID NO: 229). One or more alignments to one or more previously published protein sequences are given at the end of the application. A brief description of the relationship of the variant protein according to the present invention to each such aligned protein is as follows:

Comparison report between M77904_P4 (SEQ ID NO: 253) and Q8WU91 (SEQ ID NO: 987):

1. An isolated chimeric polypeptide encoding for M77904_P4 (SEQ ID NO: 253), comprising a first amino acid sequence being at least 90% homologous to MAGLNCGVSIALLGVLLLGAARLPRGAE-AFEIALPRESNITVLIKLGTPTLLAKPCYIVIS KRHIT-MLSIKSGERIVFTFSCQSPENHFVIE-IQKNIDCMSGPCPFGEVQLQPSTSLLPTLNR TFIWDVKAHKSIGLELQFSIPRLRQIG-PGESCPDGVTHSISGRIDATVVRIGTFCSNGTVSR IKMQEGVKMALHLPWFHPRNVSGFSIAN-RSSIKRLCIIESVFEGEGSATLMSANYPEGFP EDELMTWQFVVPAHLRASVSFLNFNL-SNCERKEERVEYYIPGSTTNPEVFKLEDKQPGN MAG-NFNLSLQGCDQDAQSPGILRLQFQVLVQHPQNES corresponding to amino acids 1-341 of Q8WU91 (SEQ ID NO: 987), which also corresponds to amino acids 1-341 of M77904_P4 (SEQ ID NO: 253), and a second amino acid sequence being at least 70%, optionally at least 80%, preferably at least 85%, more preferably at least 90% and most preferably at least 95% homologous to a polypeptide having the sequence NKIYVVDLSNERAMSLTIEPRPVKQSRK-FVPGCFVCLESRTCSSNLTLTSGSKHKISFLCD DLTRL-WMNVEKTISTPLNQCICPWPWIALLSPP-CLSGVPWVGCKSYQKGPSGRARWLT PVIPALWEAKAGGSLEVRSSRPAWPTW (SEQ ID NO: 1136) corresponding to amino acids 342-487 of M77904_P4 (SEQ ID NO: 253), wherein said first and second amino acid sequences are contiguous and in a sequential order.

2. An isolated polypeptide encoding for a tail of M77904_P4 (SEQ ID NO: 253), comprising a polypeptide being at least 70%, optionally at least about 80%, preferably at least about 85%, more preferably at least about 90% and most preferably at least about 95% homologous to the sequence NKIYVVDLSNERAMSLTIEPRPVKQSRK-FVPGCFVCLESRTCSSNLTLTSGSKHKISFLCD DLTRL-WMNVEKTISTPLNQCICPWPWIALLSPP-CLSGVPWVGCKSYQKGPSGRARWLT PVIPALWEAKAGGSLEVRSSRPAWPTW (SEQ ID NO: 1136) in M77904_P4 (SEQ ID NO: 253).

Comparison report between M77904_P4 (SEQ ID NO: 253) and Q9H5V8 (SEQ ID NO: 989) (SEQ ID NO:989):

1. An isolated chimeric polypeptide encoding for M77904_P4 (SEQ ID NO: 253), comprising a first amino acid sequence being at least 90% homologous to MAGLNCGVSIALLGVLLLGAARLPRGAE-AFEIALPRESNITVLIKLGTPTLLAKPCYIVIS KRHIT-MLSIKSGERIVFTFSCQSPENHFVIE-IQKNIDCMSGPCPFGEVQLQPSTSLLPTLNR TFIWDVKAHKSIGLELQFSIPRLRQIG-PGESCPDGVTHSISGRIDATVVRIGTFCSNGTVSR IKMQEGVKMALHLPWFHPRNVSGFSIAN-RSSIKRLCIIESVFEGEGSATLMSANYPEGFP EDELMTWQFVVPAHLRASVSFLNFNL-SNCERKEERVEYYIPGSTTNPEVFKLEDKQPGN MAG-NFNLSLQGCDQDAQSPGILRLQFQV-LVQHPQNESNKIYVVDLSNERAMSLTIEPRP VKQSRKFVPGCFVCLESRTCSSN-LTLTSGSKHKISFLCDDLTRLWMNVEKTIS corresponding to amino acids 1-416 of Q9H5V8 (SEQ ID NO: 989), which also corresponds to amino acids 1-416 of M77904_P4 (SEQ ID NO: 253), and a second amino acid sequence being at least 70%, optionally at least 80%, preferably at least 85%, more preferably at least 90% and most preferably at least 95% homologous to a polypeptide having the sequence TPLN-QCICPWPWIALLSPPCLSGVP-WVGCKSYQKGPSGRARWLTPVIPALWEAKAGGS LEVRSSRPAWPTW corresponding to amino acids 417-487 of M77904_P4 (SEQ ID NO: 253), wherein said first and second amino acid sequences are contiguous and in a sequential order.

2. An isolated polypeptide encoding for a tail of M77904_P4 (SEQ ID NO: 253), comprising a polypeptide being at least 70%, optionally at least about 80%, preferably at least about 85%, more preferably at least about 90% and most preferably at least about 95% homologous to the sequence TPLNQCICPWPWIALLSPPCLSGVP-WVGCKSYQKGPSGRARWLTPVIPALWEAKAGGS LEVRSSRPAWPTW in M77904_P4 (SEQ ID NO: 253).

Comparison report between M77904_P4 (SEQ ID NO: 253) and Q96QU7 (SEQ ID NO: 988):

1. An isolated chimeric polypeptide encoding for M77904_P4 (SEQ ID NO: 253), comprising a first amino acid sequence being at least 90% homologous to MAGLNCGVSIALLGVLLLGAARLPRGAE-AFEIALPRESNITVLIKLGTPTLLAKPCYIVIS KRHIT-MLSIKSGERIVFTFSCQSPENHFVIE-IQKNIDCMSGPCPFGEVQLQPSTSLLPTLNR TFIWDVKAHKSIGLELQFSIPRLRQIG-PGESCPDGVTHSISGRIDATVVRIGTFCSNGTVSR IKMQEGVKMALHLPWFHPRNVSGFSIAN-RSSIKRLCIIESVFEGEGSATLMSANYPEGFP EDELMTWQFVVPAHLRASVSFLNFNL-SNCERKEERVEYYIPGSTTNPEVFKLEDKQPGN MAG-NFNLSLQGCDQDAQSPGILRLQFQV-LVQHPQNESNKIYVVDLSNERAMSLTIEPRP VKQSRKFVPGCFVCLESRTCSSN-
LTLTSGSKHKISFLCDDLTRLWMNVEKTIS corresponding to amino acids 1-416 of Q96QU7 (SEQ ID NO: 988), which also corresponds to amino acids 1-416 of M77904_P4 (SEQ ID NO: 253), and a second amino acid sequence being at least 70%, optionally at least 80%, preferably at least 85%, more preferably at least 90% and most preferably at least 95% homologous to a polypeptide having the sequence TPLNQCICPWPWIALLSPPCLSGVP-
WVGCKSYQKGPSGRARWLTPVIPALWEAKAGGS
LEVRSSRPAWPTW corresponding to amino acids 417-487 of M77904_P4 (SEQ ID NO: 253), wherein said first and second amino acid sequences are contiguous and in a sequential order.

2. An isolated polypeptide encoding for a tail of M77904_P4 (SEQ ID NO: 253), comprising a polypeptide being at least 70%, optionally at least about 80%, preferably at least about 85%, more preferably at least about 90% and most preferably at least about 95% homologous to the sequence TPLNQCICPWPWIALLSPPCLSGVP-
WVGCKSYQKGPSGRARWLTPVIPALWEAKAGGS
LEVRSSRPAWPTW in M77904_P4 (SEQ ID NO: 253).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M77904_P4 (SEQ ID NO: 253) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein M77904_P4 (SEQ ID NO: 253) sequence provides support for the deduced sequence of this variant protein according to the present invention).

TABLE 8

Amino acid mutations

| SNP position(s) on amino acid sequence | Alternative amino acid(s) | Previously known SNP? |
|---|---|---|
| 329 | Q -> R | No |

Variant protein M77904_P4 (SEQ ID NO: 253) is encoded by the following transcript(s): M77904_T8 (SEQ ID NO: 229), for which the sequence(s) is/are given at the end of the application. The coding portion of transcript M77904_T8 (SEQ ID NO: 229) is shown in bold; this coding portion starts at position 137 and ends at position 1597. The transcript also has the following SNPs as listed in Table 9 (given according to their position on the nucleotide sequence, with the alternative nucleic acid listed; the last column indicates whether the SNP is known or not; the presence of known SNPs in variant protein M77904_P4 (SEQ ID NO: 253) sequence provides support for the deduced sequence of this variant protein according to the present invention).

TABLE 9

Nucleic acid SNPs

| SNP position on nucleotide sequence | Alternative nucleic acid | Previously known SNP? |
|---|---|---|
| 54 | G -> | No |
| 59 | G -> | No |
| 131 | G -> C | Yes |
| 658 | C -> T | No |
| 682 | T -> C | No |
| 1054 | G -> A | Yes |
| 1122 | A -> G | No |

Variant protein M77904_P5 (SEQ ID NO: 254) according to the present invention has an amino acid sequence as given at the end of the application; it is encoded by transcript(s) M77904_T9 (SEQ ID NO: 230). One or more alignments to one or more previously published protein sequences are given at the end of the application. A brief description of the relationship of the variant protein according to the present invention to each such aligned protein is as follows:

Comparison report between M77904_P5 (SEQ ID NO: 254) and Q96QU7 (SEQ ID NO: 988):

1. An isolated chimeric polypeptide encoding for M77904_P5 (SEQ ID NO: 254), comprising a first amino acid sequence being at least 90% homologous to MIIQEQR-TRAEEIFSLDEDVLPKPSFHHHSF-
WVNISNCSPTSGKQLDLLFSVTLTPRTVDL TVIL-IAAVGGGVLLLSALGLIICCVKKKKKKTNKGPAVGIY NGNINTEMPRQPKKFQKG RKDNDSHVYAVIEDTM-VYGHLLQDSSGSFLQPEVDTYRPFQGT-
MGVCPPSPPTICSRAP TAKLATEEPPPRSPPE-SESEPYTFSHPNNGDVSSKDTDIPLLNTQEPMEPAE corresponding to amino acids 606-836 of Q96QU7 (SEQ ID NO: 988), which also corresponds to amino acids 1-231 of M77904_P5 (SEQ ID NO: 254).

Comparison report between M77904_P5 (SEQ ID NO: 254) and Q9H$_8$C2 (SEQ ID NO: 990) (SEQ ID NO:990):

1. An isolated chimeric polypeptide encoding for M77904_P5 (SEQ ID NO: 254), comprising a first amino acid sequence being at least 90% homologous to MIIQEQR-TRAEEIFSLDEDVLPKPSFHHHSF-
WVNISNCSPTSGKQLDLLFSVTLTPRTVDL TVIL-IAAVGGGVLLLSALGLIICCVKKKKKKTNKGPAVGIY NGNINTEMPRQPKKFQKG RKDNDSHVYAVIEDTM-VYGHLLQDSSGSFLQPEVDTYRPFQGT-
MGVCPPSPPTICSRAP TAKLATEEPPPRSPPE-SESEPYTFSHPNNGDVSSKDTDIPLLNTQEPMEPAE corresponding to amino acids 419-649 of Q9H$_8$C2 (SEQ ID NO: 990), which also corresponds to amino acids 1-231 of M77904_P5 (SEQ ID NO: 254).

The location of the variant protein was determined according to results from a number of different software programs and analyses, including analyses from SignalP and other specialized programs. The variant protein is believed to be located as follows with regard to the cell: membrane. The protein localization is believed to be membrane because both trans-membrane region prediction programs predicted a trans-membrane region for this protein. In addition both signal-peptide prediction programs predict that this protein is a non-secreted protein.

Variant protein M77904_P5 (SEQ ID NO: 254) also has the following non-silent SNPs (Single Nucleotide Polymorphisms) as listed in Table 10, (given according to their position(s) on the amino acid sequence, with the alternative amino acid(s) listed; the last column indicates whether the SNP is known or not; the presence of known SNPs in variant protein M77904_P5 (SEQ ID NO: 254) sequence provides support for the deduced sequence of this variant protein according to the present invention).

TABLE 10

Amino acid mutations

| SNP position(s) on amino acid sequence | Alternative amino acid(s) | Previously known SNP? |
|---|---|---|
| 104 | G -> D | Yes |

Variant protein M77904_P5 (SEQ ID NO: 254) is encoded by the following transcript(s): M77904_T9 (SEQ ID NO: 230), for which the sequence(s) is/are given at the end of the application. The coding portion of transcript M77904_T9 (SEQ ID NO: 230) is shown in bold; this coding portion starts at position 1226 and ends at position 1918. The transcript also has the following SNPs as listed in Table 11 (given according to their position on the nucleotide sequence, with the alternative nucleic acid listed; the last column indicates whether the SNP is known or not; the presence of known SNPs in variant protein M77904_P5 (SEQ ID NO: 254) sequence provides support for the deduced sequence of this variant protein according to the present invention).

TABLE 11

Nucleic acid SNPs

| SNP position on nucleotide sequence | Alternative nucleic acid | Previously known SNP? |
|---|---|---|
| 248 | A -> C | Yes |
| 318 | G -> C | Yes |
| 3131 | A -> T | Yes |
| 3201 | G -> A | Yes |
| 3271 | A -> G | Yes |
| 3331 | C -> A | Yes |
| 3485 | G -> A | Yes |
| 3984 | C -> T | Yes |
| 4421 | G -> A | No |
| 4680 | A -> C | Yes |
| 4700 | A -> G | Yes |
| 4791 | T -> C | Yes |
| 984 | A -> G | Yes |
| 4861 | T -> C | Yes |
| 4878 | C -> A | Yes |
| 4882 | G -> A | Yes |
| 4949 | T -> G | Yes |
| 5033 | A -> C | No |
| 994 | C -> T | Yes |
| 1456 | T -> C | No |
| 1536 | G -> A | Yes |
| 2414 | T -> C | No |
| 2493 | G -> A | Yes |
| 2647 | T -> G | Yes |
| 2836 | C -> T | Yes |

Variant protein M77904_P7 (SEQ ID NO: 255) according to the present invention has an amino acid sequence as given at the end of the application; it is encoded by transcript(s) M77904_T11 (SEQ ID NO: 227). One or more alignments to one or more previously published protein sequences are given at the end of the application. A brief description of the relationship of the variant protein according to the present invention to each such aligned protein is as follows:

Comparison report between M77904_P7 (SEQ ID NO: 255) and Q8WU91 (SEQ ID NO: 987):

1. An isolated chimeric polypeptide encoding for M77904_P7 (SEQ ID NO: 255), comprising a first amino acid sequence being at least 90% homologous to MAGLNCGVSIALLGVLLLGAARLPRGAE-AFEIALPRESNITVLIKLGTPTLLAKPCYIVIS KRHIT-MLSIKSGERIVFTFSCQSPENHFVIE-IQKNIIDCMSGPCPFGEVQLQPSTSLLPTLNR TFIWDVKAHKSIGLELQFSIPRLRQIG-PGESCPDGVTHSISGRIDATVVRIGTFCSNGTVSR IKMQEGVKMALHLPWFHPRNVSGFSIANRSSIKR corresponding to amino acids 1-219 of Q8WU91 (SEQ ID NO: 987), which also corresponds to amino acids 1-219 of M77904_P7 (SEQ ID NO: 255), and a second amino acid sequence being at least 70%, optionally at least 80%, preferably at least 85%, more preferably at least 90% and most preferably at least 95% homologous to a polypeptide having the sequence EKAPPCYLIRLKHTRSSLF (SEQ ID NO: 1137) corresponding to amino acids 220-238 of M77904_P7 (SEQ ID NO: 255), wherein said first and second amino acid sequences are contiguous and in a sequential order.

2. An isolated polypeptide encoding for a tail of M77904_P7 (SEQ ID NO: 255), comprising a polypeptide being at least 70%, optionally at least about 80%, preferably at least about 85%, more preferably at least about 90% and most preferably at least about 95% homologous to the sequence EKAPPCYLIRLKHTRSSLF (SEQ ID NO: 1137) in M77904_P7 (SEQ ID NO: 255).

Comparison report between M77904_P7 (SEQ ID NO: 255) and Q9H5V8 (SEQ ID NO: 989):

1. An isolated chimeric polypeptide encoding for M77904_P7 (SEQ ID NO: 255), comprising a first amino acid sequence being at least 90% homologous to MAGLNCGVSIALLGVLLLGAARLPRGAE-AFEIALPRESNITVLIKLGTPTLLAKPCYIVIS KRHIT-MLSIKSGERIVFTFSCQSPENHFVIE-IQKNIDCMSGPCPFGEVQLQPSTSLLPTLNR TFIWDVKAHKSIGLELQFSIPRLRQIG-PGESCPDGVTHSISGRIDATVVRIGTFCSNGTVSR IKMQEGVKMALHLPWFHPRNVSGFSIANRSSIKR corresponding to amino acids 1-219 of Q9H5V8 (SEQ ID NO: 989), which also corresponds to amino acids 1-219 of M77904_P7 (SEQ ID NO: 255), and a second amino acid sequence being at least 70%, optionally at least 80%, preferably at least 85%, more preferably at least 90% and most preferably at least 95% homologous to a polypeptide having the sequence EKAPPCYLIRLKHTRSSLF (SEQ ID NO: 1137) corresponding to amino acids 220-238 of M77904_P7 (SEQ ID NO: 255), wherein said first and second amino acid sequences are contiguous and in a sequential order.

2. An isolated polypeptide encoding for a tail of M77904_P7 (SEQ ID NO: 255), comprising a polypeptide being at least 70%, optionally at least about 80%, preferably at least about 85%, more preferably at least about 90% and most preferably at least about 95% homologous to the sequence EKAPPCYLIRLKHTRSSLF (SEQ ID NO: 1137) in M77904_P7 (SEQ ID NO: 255).

Comparison report between M77904_P7 (SEQ ID NO: 255) and Q96QU7 (SEQ ID NO: 988):

1. An isolated chimeric polypeptide encoding for M77904_P7 (SEQ ID NO: 255), comprising a first amino acid sequence being at least 90% homologous to MAGLNCGVSIALLGVLLLGAARLPRGAE-AFEIALPRESNITVLIKLGTPTLLAKPCYIVIS KRHIT-MLSIKSGERIVFTFSCQSPENHFVIE-IQKNIDCMSGPCPFGEVQLQPSTSLLPTLNR TFIWDVKAHKSIGLELQFSIPRLRQIG-PGESCPDGVTHSISGRIDATVVRIGTFCSNGTVSR IKMQEGVKMALHLPWFHPRNVSGFSIANRSSIKR corresponding to amino acids 1-219 of Q96QU7 (SEQ ID NO:

988), which also corresponds to amino acids 1-219 of M77904_P7 (SEQ ID NO: 255), and a second amino acid sequence being at least 70%, optionally at least 80%, preferably at least 85%, more preferably at least 90% and most preferably at least 95% homologous to a polypeptide having the sequence EKAPPCYLIRLKHTRSSLF (SEQ ID NO: 1137) corresponding to amino acids 220-238 of M77904_P7 (SEQ ID NO: 255), wherein said first and second amino acid sequences are contiguous and in a sequential order.

2. An isolated polypeptide encoding for a tail of M77904_P7 (SEQ ID NO: 255), comprising a polypeptide being at least 70%, optionally at least about 80%, preferably at least about 85%, more preferably at least about 90% and most preferably at least about 95% homologous to the sequence EKAPPCYLIRLKHTRSSLF (SEQ ID NO: 1137) in M77904_P7 (SEQ ID NO: 255).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M77904_P7 (SEQ ID NO: 255) is encoded by the following transcript(s): M77904_T11 (SEQ ID NO: 227), for which the sequence(s) is/are given at the end of the application. The coding portion of transcript M77904_T11 (SEQ ID NO: 227) is shown in bold; this coding portion starts at position 137 and ends at position 850. The transcript also has the following SNPs as listed in Table 12 (given according to their position on the nucleotide sequence, with the alternative nucleic acid listed; the last column indicates whether the SNP is known or not; the presence of known SNPs in variant protein M77904_P7 (SEQ ID NO: 255) sequence provides support for the deduced sequence of this variant protein according to the present invention).

TABLE 12

Nucleic acid SNPs

| SNP position on nucleotide sequence | Alternative nucleic acid | Previously known SNP? |
|---|---|---|
| 54 | G -> | No |
| 59 | G -> | No |
| 2361 | A -> G | No |
| 131 | G -> C | Yes |
| 658 | C -> T | No |
| 682 | T -> C | No |
| 943 | C -> T | Yes |
| 1667 | G -> A | No |
| 1700 | G -> A | No |
| 1807 | T -> C | Yes |
| 2293 | G -> A | Yes |

As noted above, cluster M77904 features 21 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster M77904_node_0 (SEQ ID NO: 231) according to the present invention is supported by 32 libraries. The number of libraries was determined as previously described. This segment can be found in the following transcript(s): M77904_T11 (SEQ ID NO: 227) and M77904_T8 (SEQ ID NO: 229). Table 13 below describes the starting and ending position of this segment on each transcript.

TABLE 13

Segment location on transcripts

| Transcript name | Segment starting position | Segment ending position |
|---|---|---|
| M77904_T11 (SEQ ID NO:227) | 1 | 218 |
| M77904_T8 (SEQ ID NO:229) | 1 | 218 |

Segment cluster M77904_node_11 (SEQ ID NO: 232) according to the present invention is supported by 37 libraries. The number of libraries was determined as previously described.

This segment can be found in the following transcript(s): M77904_T3 (SEQ ID NO: 228) and M77904_T8 (SEQ ID NO: 229). Table 14 below describes the starting and ending position of this segment on each transcript.

TABLE 14

Segment location on transcripts

| Transcript name | Segment starting position | Segment ending position |
|---|---|---|
| M77904_T3 (SEQ ID NO:228) | 1064 | 1285 |
| M77904_T8 (SEQ ID NO:229) | 1161 | 1382 |

Segment cluster M77904_node_12 (SEQ ID NO: 233) according to the present invention is supported by 4 libraries. The number of libraries was determined as previously described. This segment can be found in the following transcript(s): M77904_T8 (SEQ ID NO: 229). Table 15 below describes the starting and ending position of this segment on each transcript.

TABLE 15

Segment location on transcripts

| Transcript name | Segment starting position | Segment ending position |
|---|---|---|
| M77904_T8 (SEQ ID NO:229) | 1383 | 1785 |

Segment cluster M77904_node_14 (SEQ ID NO: 234) according to the present invention is supported by 5 libraries. The number of libraries was determined as previously described. This segment can be found in the following transcript(s): M77904_T9 (SEQ ID NO: 230). Table 16 below describes the starting and ending position of this segment on each transcript.

TABLE 16

Segment location on transcripts

| Transcript name | Segment starting position | Segment ending position |
|---|---|---|
| M77904_T9 (SEQ ID NO:230) | 1 | 656 |

Segment cluster M77904_node__15 (SEQ ID NO: 235) according to the present invention is supported by 44 libraries. The number of libraries was determined as previously described. This segment can be found in the following transcript(s): M77904_T3 (SEQ ID NO: 228) and M77904_T9 (SEQ ID NO: 230). Table 17 below describes the starting and ending position of this segment on each transcript.

TABLE 17

Segment location on transcripts

| Transcript name | Segment starting position | Segment ending position |
|---|---|---|
| M77904_T3 (SEQ ID NO:228) | 1286 | 1666 |
| M77904_T9 (SEQ ID NO:230) | 657 | 1037 |

Segment cluster M77904_node__17 (SEQ ID NO: 236) according to the present invention is supported by 48 libraries. The number of libraries was determined as previously described. This segment can be found in the following transcript(s): M77904_T3 (SEQ ID NO: 228) and M77904_T9 (SEQ ID NO: 230). Table 18 below describes the starting and ending position of this segment on each transcript.

TABLE 18

Segment location on transcripts

| Transcript name | Segment starting position | Segment ending position |
|---|---|---|
| M77904_T3 (SEQ ID NO:228) | 1667 | 2032 |
| M77904_T9 (SEQ ID NO:230) | 1038 | 1403 |

Segment cluster M77904_node__2 (SEQ ID NO: 237) according to the present invention is supported by 1 libraries. The number of libraries was determined as previously described. This segment can be found in the following transcript(s): M77904_T3 (SEQ ID NO: 228). Table 19 below describes the starting and ending position of this segment on each transcript.

TABLE 19

Segment location on transcripts

| Transcript name | Segment starting position | Segment ending position |
|---|---|---|
| M77904_T3 (SEQ ID NO:228) | 1 | 121 |

Segment cluster M77904_node__21 (SEQ ID NO: 238) according to the present invention is supported by 54 libraries. The number of libraries was determined as previously described. This segment can be found in the following transcript(s): M77904_T3 (SEQ ID NO: 228) and M77904_T9 (SEQ ID NO: 230). Table 20 below describes the starting and ending position of this segment on each transcript.

TABLE 20

Segment location on transcripts

| Transcript name | Segment starting position | Segment ending position |
|---|---|---|
| M77904_T3 (SEQ ID NO:228) | 2121 | 4095 |
| M77904_T9 (SEQ ID NO:230) | 1492 | 3466 |

Segment cluster M77904_node__23 (SEQ ID NO: 239) according to the present invention is supported by 24 libraries. The number of libraries was determined as previously described. This segment can be found in the following transcript(s): M77904_T3 (SEQ ID NO: 228) and M77904_T9 (SEQ ID NO: 230). Table 21 below describes the starting and ending position of this segment on each transcript.

TABLE 21

Segment location on transcripts

| Transcript name | Segment starting position | Segment ending position |
|---|---|---|
| M77904_T3 (SEQ ID NO:228) | 4106 | 4375 |
| M77904_T9 (SEQ ID NO:230) | 3477 | 3746 |

Segment cluster M77904_node__24 (SEQ ID NO: 240) according to the present invention is supported by 48 libraries. The number of libraries was determined as previously described. This segment can be found in the following transcript(s): M77904_T3 (SEQ ID NO: 228) and M77904_T9 (SEQ ID NO: 230). Table 22 below describes the starting and ending position of this segment on each transcript.

TABLE 22

Segment location on transcripts

| Transcript name | Segment starting position | Segment ending position |
|---|---|---|
| M77904_T3 (SEQ ID NO:228) | 4376 | 4785 |
| M77904_T9 (SEQ ID NO:230) | 3747 | 4156 |

Segment cluster M77904_node__27 (SEQ ID NO: 241) according to the present invention is supported by 81 libraries. The number of libraries was determined as previously described. This segment can be found in the following transcript(s): M77904_T3 (SEQ ID NO: 228) and M77904_T9 (SEQ ID NO: 230). Table 23 below describes the starting and ending position of this segment on each transcript.

TABLE 23

Segment location on transcripts

| Transcript name | Segment starting position | Segment ending position |
|---|---|---|
| M77904_T3 (SEQ ID NO:228) | 4994 | 5482 |
| M77904_T9 (SEQ ID NO:230) | 4365 | 4853 |

Segment cluster M77904_node__28 (SEQ ID NO: 242) according to the present invention is supported by 55 libraries. The number of libraries was determined as previously described. This segment can be found in the following transcript(s): M77904_T3 (SEQ ID NO: 228) and M77904_T9 (SEQ ID NO: 230). Table 24 below describes the starting and ending position of this segment on each transcript.

TABLE 24

Segment location on transcripts

| Transcript name | Segment starting position | Segment ending position |
|---|---|---|
| M77904_T3 (SEQ ID NO:228) | 5483 | 5914 |
| M77904_T9 (SEQ ID NO:230) | 4854 | 5285 |

Segment cluster M77904_node__4 (SEQ ID NO: 243) according to the present invention is supported by 35 libraries. The number of libraries was determined as previously described. This segment can be found in the following transcript(s): M77904_T11 (SEQ ID NO: 227), M77904_T3 (SEQ ID NO: 228) and M77904_T8 (SEQ ID NO: 229). Table 25 below describes the starting and ending position of this segment on each transcript.

TABLE 25

Segment location on transcripts

| Transcript name | Segment starting position | Segment ending position |
|---|---|---|
| M77904_T11 (SEQ ID NO:227) | 219 | 428 |
| M77904_T3 (SEQ ID NO:228) | 122 | 331 |
| M77904_T8 (SEQ ID NO:229) | 219 | 428 |

Segment cluster M77904_node__6 (SEQ ID NO: 244) according to the present invention is supported by 44 libraries. The number of libraries was determined as previously described. This segment can be found in the following transcript(s): M77904_T11 (SEQ ID NO: 227), M77904_T3 (SEQ ID NO: 228) and M77904_T8 (SEQ ID NO: 229). Table 26 below describes the starting and ending position of this segment on each transcript.

TABLE 26

Segment location on transcripts

| Transcript name | Segment starting position | Segment ending position |
|---|---|---|
| M77904_T11 (SEQ ID NO:227) | 429 | 791 |
| M77904_T3 (SEQ ID NO:228) | 332 | 694 |
| M77904_T8 (SEQ ID NO:229) | 429 | 791 |

Segment cluster M77904_node__7 (SEQ ID NO: 245) according to the present invention is supported by 4 libraries. The number of libraries was determined as previously described. This segment can be found in the following transcript(s): M77904_T11 (SEQ ID NO: 227). Table 27 below describes the starting and ending position of this segment on each transcript.

TABLE 27

Segment location on transcripts

| Transcript name | Segment starting position | Segment ending position |
|---|---|---|
| M77904_T11 (SEQ ID NO:227) | 792 | 2030 |

Segment cluster M77904_node__8 (SEQ ID NO: 246) according to the present invention is supported by 50 libraries. The number of libraries was determined as previously described. This segment can be found in the following transcript(s): M77904_T11 (SEQ ID NO: 227), M77904_T3 (SEQ ID NO: 228) and M77904_T8 (SEQ ID NO: 229). Table 28 below describes the starting and ending position of this segment on each transcript.

TABLE 28

Segment location on transcripts

| Transcript name | Segment starting position | Segment ending position |
|---|---|---|
| M77904_T11 (SEQ ID NO:227) | 2031 | 2399 |
| M77904_T3 (SEQ ID NO:228) | 695 | 1063 |
| M77904_T8 (SEQ ID NO:229) | 792 | 1160 |

Segment cluster M77904_node__9 (SEQ ID NO: 247) according to the present invention is supported by 11 libraries. The number of libraries was determined as previously described. This segment can be found in the following transcript(s): M77904_T11 (SEQ ID NO: 227). Table 29 below describes the starting and ending position of this segment on each transcript.

TABLE 29

Segment location on transcripts

| Transcript name | Segment starting position | Segment ending position |
|---|---|---|
| M77904_T11 (SEQ ID NO:227) | 2400 | 2658 |

According to an optional embodiment of the present invention, short segments related to the above cluster are also provided. These segments are up to about 120 bp in length, and so are included in a separate description.

Segment cluster M77904_node__19 (SEQ ID NO: 248) according to the present invention is supported by 42 libraries. The number of libraries was determined as previously described. This segment can be found in the following transcript(s): M77904_T3 (SEQ ID NO: 228) and M77904_T9 (SEQ ID NO: 230). Table 30 below describes the starting and ending position of this segment on each transcript.

TABLE 30

Segment location on transcripts

| Transcript name | Segment starting position | Segment ending position |
|---|---|---|
| M77904_T3 (SEQ ID NO:228) | 2033 | 2120 |
| M77904_T9 (SEQ ID NO:230) | 1404 | 1491 |

Segment cluster M77904_node__22 (SEQ ID NO: 249) according to the present invention can be found in the following transcript(s): M77904_T3 (SEQ ID NO: 228) and M77904_T9 (SEQ ID NO: 230). Table 31 below describes the starting and ending position of this segment on each transcript.

TABLE 31

Segment location on transcripts

| Transcript name | Segment starting position | Segment ending position |
|---|---|---|
| M77904_T3 (SEQ ID NO:228) | 4096 | 4105 |
| M77904_T9 (SEQ ID NO:230) | 3467 | 3476 |

Segment cluster M77904_node__25 (SEQ ID NO: 250) according to the present invention is supported by 40 libraries. The number of libraries was determined as previously described. This segment can be found in the following transcript(s): M77904_T3 (SEQ ID NO: 228) and M77904_T9 (SEQ ID NO: 230). Table 32 below describes the starting and ending position of this segment on each transcript.

TABLE 32

Segment location on transcripts

| Transcript name | Segment starting position | Segment ending position |
|---|---|---|
| M77904_T3 (SEQ ID NO:228) | 4786 | 4896 |

TABLE 32-continued

Segment location on transcripts

| Transcript name | Segment starting position | Segment ending position |
|---|---|---|
| M77904_T9 (SEQ ID NO:230) | 4157 | 4267 |

Segment cluster M77904_node__26 (SEQ ID NO: 251) according to the present invention is supported by 39 libraries. The number of libraries was determined as previously described. This segment can be found in the following transcript(s): M77904_T3 (SEQ ID NO: 228) and M77904_T9 (SEQ ID NO: 230). Table 33 below describes the starting and ending position of this segment on each transcript.

TABLE 33

Segment location on transcripts

| Transcript name | Segment starting position | Segment ending position |
|---|---|---|
| M77904_T3 (SEQ ID NO:228) | 4897 | 4993 |
| M77904_T9 (SEQ ID NO:230) | 4268 | 4364 |

Microarray (chip) data is also available for this gene as follows. As described above with regard to the cluster itself, various oligonucleotides were tested for being differentially expressed in various disease conditions, particularly cancer. The following oligonucleotide was found to hit this segment (with regard to ovarian cancer), shown in Table 33.

TABLE 33

Oligonucleotide related to this gene

| Oligonucleotide name | Overexpressed in cancers | Chip reference |
|---|---|---|
| M77904_0_8_0 (SEQ ID NO:1016) | Ovarian cancer | Ovary |

Variant protein alignment to the previously known protein:

Sequence name: /tmp/c2Fe8npYgJ/QPDZHH46X1: Q8WU91 (SEQ ID NO: 987)

Sequence documentation:

Alignment of: M77904_P2 (SEQ ID NO: 252) x Q8WU91 (SEQ ID NO: 987) . . .

Alignment segment 1/1:

Quality: 2730.00

Escore: 0

Matching length: 275 Total length: 275

Matching Percent Similarity: 100.00 Matching Percent

Identity: 100.00

Total Percent Similarity: 100.00 Total Percent

Identity: 100.00

Gaps: 0

Alignment:

```
  1  MLSIKSGERIVFTFSCQSPENHFVIEIQKNIDCMSGPCPFGEVQLQPSTS   50
     ||||||||||||||||||||||||||||||||||||||||||||||||||
 67  MLSIKSGERIVFTFSCQSPENHFVIEIQKNIDCMSGPCPFGEVQLQPSTS  116

51  LLPTLNRTFIWDVKAHKSIGLELQFSIPRLRQIGPGESCPDGVTHSISGR  100
     ||||||||||||||||||||||||||||||||||||||||||||||||||
117  LLPTLNRTFIWDVKAHKSIGLELQFSIPRLRQIGPGESCPDGVTHSISGR  166

101  IDATVVRIGTFCSNGTVSRIKMQEGVKMALHLPWFHPRNVSGFSIANRSS  150
     ||||||||||||||||||||||||||||||||||||||||||||||||||
167  IDATVVRIGTFCSNGTVSRIKMQEGVKMALHLPWFHPRNVSGFSIANRSS  216

151  IKRLCIIESVFEGEGSATLMSANYPEGFPEDELMTWQFVVPAHLRASVSF  200
     ||||||||||||||||||||||||||||||||||||||||||||||||||
217  IKRLCIIESVFEGEGSATLMSANYPEGFPEDELMTWQFVVPAHLRASVSF  266

201  LNFNLSNCERKEERVEYYIPGSTTNPEVFKLEDKQPGNMAGNFNLSLQGC  250
     ||||||||||||||||||||||||||||||||||||||||||||||||||
267  LNFNLSNCERKEERVEYYIPGSTTNPEVFKLEDKQPGNMAGNFNLSLQGC  316

251  DQDAQSPGILRLQFQVLVQHPQNES                           275
     |||||||||||||||||||||||||
317  DQDAQSPGILRLQFQVLVQHPQNES                           341
```

Sequence name: /tmp/c2Fe8npYgJ/QPDZHH46X1: Q96QU7 (SEQ ID NO: 988)

Sequence documentation:

Alignment of: M77904_P2 (SEQ ID NO: 252) x Q96QU7 (SEQ ID NO: 988) . . .

Alignment segment 1/1:
  Quality: 7633.00

Escore: 0
  Matching length: 770 Total length: 770

Matching Percent Similarity: 100.00 Matching Percent Identity: 100.00

Total Percent Similarity: 100.00 Total Percent Identity: 100.00

Gaps: 0

Alignment:

```
  1  MLSIKSGERIVFTFSCQSPENHFVIEIQKNIDCMSGPCPFGEVQLQPSTS   50
     ||||||||||||||||||||||||||||||||||||||||||||||||||
 67  MLSIKSGERIVFTFSCQSPENHFVIEIQKNIDCMSGPCPFGEVQLQPSTS  116

51  LLPTLNRTFIWDVKAHKSIGLELQFSIPRLRQIGPGESCPDGVTHSISGR  100
     ||||||||||||||||||||||||||||||||||||||||||||||||||
117  LLPTLNRTFIWDVKAHKSIGLELQFSIPRLRQIGPGESCPDGVTHSISGR  166

101  IDATVVRIGTFCSNGTVSRIKMQEGVKMALHLPWFHPRNVSGFSIANRSS  150
     ||||||||||||||||||||||||||||||||||||||||||||||||||
167  IDATVVRIGTFCSNGTVSRIKMQEGVKMALHLPWFHPRNVSGFSIANRSS  216

151  IKRLCIIESVFEGEGSATLMSANYPEGFPEDELMTWQFVVPAHLRASVSF  200
     ||||||||||||||||||||||||||||||||||||||||||||||||||
217  IKRLCIIESVFEGEGSATLMSANYPEGFPEDELMTWQFVVPAHLRASVSF  266

201  LNFNLSNCERKEERVEYYIPGSTTNPEVFKLEDKQPGNMAGNFNLSLQGC  250
     ||||||||||||||||||||||||||||||||||||||||||||||||||
267  LNFNLSNCERKEERVEYYIPGSTTNPEVFKLEDKQPGNMAGNFNLSLQGC  316

251  DQDAQSPGILRLQFQVLVQHPQNESNKIYVVDLSNERAMSLTIEPRPVKQ  300
     ||||||||||||||||||||||||||||||||||||||||||||||||||
317  DQDAQSPGILRLQFQVLVQHPQNESNKIYVVDLSNERAMSLTIEPRPVKQ  366

301  SRKFVPGCFVCLESRTCSSNLTLTSGSKHKISFLCDDLTRLWMNVEKTIS  350
     ||||||||||||||||||||||||||||||||||||||||||||||||||
367  SRKFVPGCFVCLESRTCSSNLTLTSGSKHKISFLCDDLTRLWMNVEKTIS  416

351  CTDHRYCQRKSYSLQVPSDILHLPVELHDFSWKLLVPKDRLSLVLVPAQK  400
     ||||||||||||||||||||||||||||||||||||||||||||||||||
417  CTDHRYCQRKSYSLQVPSDILHLPVELHDFSWKLLVPKDRLSLVLVPAQK  466
```

```
401  LQQHTHEKPCNTSFSYLVASAIPSQDLYFGSFCPGGSIKQIQVKQNISVT  450
     |||||||||||||||||||||||||||||||||||||||||||||||||
467  LQQHTHEKPCNTSFSYLVASAIPSQDLYFGSFCPGGSIKQIQVKQNISVT  516

451  LRTFAPSFQQEASRQGLTVSFIPYFKEEGVFTVTPDTKSKVYLRTPNWDR  500
     |||||||||||||||||||||||||||||||||||||||||||||||||
517  LRTFAPSFQQEASRQGLTVSFIPYFKEEGVFTVTPDTKSKVYLRTPNWDR  566

501  GLPSLTSVSWNISVPRDQVACLTFFKERSGVVCQTGRAFMIIQEQRTRAE  550
     |||||||||||||||||||||||||||||||||||||||||||||||||
567  GLPSLTSVSWNISVPRDQVACLTFFKERSGVVCQTGRAFMIIQEQRTRAE  616

551  EIFSLDEDVLPKPSFHHHSFWVNISNCSPTSGKQLDLLFSVTLTPRTVDL  600
     |||||||||||||||||||||||||||||||||||||||||||||||||
617  EIFSLDEDVLPKPSFHHHSFWVNISNCSPTSGKQLDLLFSVTLTPRTVDL  666

601  TVILIAAVGGGVLLLSALGLIICCVKKKKKKTNKGPAVGIYNGNINTEMP  650
     |||||||||||||||||||||||||||||||||||||||||||||||||
667  TVILIAAVGGGVLLLSALGLIICCVKKKKKKTNKGPAVGIYNGNINTEMP  716

651  RQPKKFQKGRKDNDSHVYAVIEDTMVYGHLLQDSSGSFLQPEVDTYRPFQ  700
     |||||||||||||||||||||||||||||||||||||||||||||||||
717  RQPKKFQKGRKDNDSHVYAVIEDTMVYGHLLQDSSGSFLQPEVDTYRPFQ  766

701  GTMGVCPPSPPTICSRAPTAKLATEEPPPRSPPESESEPYTFSHPNNGDV  750
     |||||||||||||||||||||||||||||||||||||||||||||||||
767  GTMGVCPPSPPTICSRAPTAKLATEEPPPRSPPESESEPYTFSHPNNGDV  816

751  SSKDTDIPLLNTQEPMEPAE                                770
     ||||||||||||||||||||
817  SSKDTDIPLLNTQEPMEPAE                                836
```

Sequence name: /tmp/4AUsKD5TnV/TBRg9DoebW: Q8WU91 (SEQ ID NO: 987)

length: 341

Sequence documentation:

Alignment of: M77904_P4 (SEQ ID NO: 253) x Q8WU91 (SEQ ID NO: 987)...

Alignment segment 1/1:

Quality: 3341.00

Escore: 0

Matching length: 341 Total

Matching Percent Similarity: 100.00 Matching Percent Identity: 100.00

Total Percent Similarity: 100.00 Total Percent Identity: 100.00

Gaps: 0

Alignment:

```
  1  MAGLNCGVSIALLGVLLLGAARLPRGAEAFEIALPRESNITVLIKLGTPT   50
     |||||||||||||||||||||||||||||||||||||||||||||||||
  1  MAGLNCGVSIALLGVLLLGAARLPRGAEAFEIALPRESNITVLIKLGTPT   50

51  LLAKPCYIVISKRHITMLSIKSGERIVFTFSCQSPENHFVIEIQKNIDCM  100
     |||||||||||||||||||||||||||||||||||||||||||||||||
 51  LLAKPCYIVISKRHITMLSIKSGERIVFTFSCQSPENHFVIEIQKNIDCM  100

101  SGPCPFGEVQLQPSTSLLPTLNRTFIWDVKAHKSIGLELQFSIPRLRQIG  150
     |||||||||||||||||||||||||||||||||||||||||||||||||
101  SGPCPFGEVQLQPSTSLLPTLNRTFIWDVKAHKSIGLELQFSIPRLRQIG  150

151  PGESCPDGVTHSISGRIDATVVRIGTFCSNGTVSRIKMQEGVKMALHLPW  200
     |||||||||||||||||||||||||||||||||||||||||||||||||
151  PGESCPDGVTHSISGRIDATVVRIGTFCSNGTVSRIKMQEGVKMALHLPW  200

201  FHPRNVSGFSIANRSSIKRLCIIESVFEGEGSATLMSANYPEGFPEDELM  250
     |||||||||||||||||||||||||||||||||||||||||||||||||
201  FHPRNVSGFSIANRSSIKRLCIIESVFEGEGSATLMSANYPEGFPEDELM  250

251  TWQFVVPAHLRASVSFLNFNLSNCERKEERVEYYIPGSTTNPEVFKLEDK  300
     |||||||||||||||||||||||||||||||||||||||||||||||||
251  TWQFVVPAHLRASVSFLNFNLSNCERKEERVEYYIPGSTTNPEVFKLEDK  300

301  QPGNMAGNFNLSLQGCDQDAQSPGILRLQFQVLVQHPQNES            341
     ||||||||||||||||||||||||||||||||||||||||
301  QPGNMAGNFNLSLQGCDQDAQSPGILRLQFQVLVQHPQNES            341
```

Sequence name: /tmp/4AUsKD5TnV/TBRg9DoebW: Q9H5V8 (SEQ ID NO: 989)

Sequence documentation:

Alignment of: M77904_P4 (SEQ ID NO: 253) x Q9H5V8 (SEQ ID NO: 989) . . .

Alignment segment 1/1:
Quality: 4081.00

Escore: 0
Matching length: 416 Total
length: 416

Matching Percent Similarity: 100.00 Matching Percent Identity: 100.00
Total Percent Similarity: 100.00 Total Percent Identity: 100.00
Gaps: 0

Alignment:

Sequence documentation:

Alignment of: M77904_P4 (SEQ ID NO: 253) x Q96QU7 (SEQ ID NO: 988) . . .

Alignment segment 1/1:
Quality: 4081.00

Escore: 0
Matching length: 416 Total
length: 416

Matching Percent Similarity: 100.00 Matching Percent Identity: 100.00
Total Percent Similarity: 100.00 Total Percent Identity: 100.00
Gaps: 0

```
  1  MAGLNCGVSIALLGVLLLGAARLPRGAEAFEIALPRESNITVLIKLGTPT   50
     ||||||||||||||||||||||||||||||||||||||||||||||||||
  1  MAGLNCGVSIALLGVLLLGAARLPRGAEAFEIALPRESNITVLIKLGTPT   50

51  LLAKPCYIVISKRHITMLSIKSGERIVFTFSCQSPENHFVIEIQKNIDCM  100
     ||||||||||||||||||||||||||||||||||||||||||||||||||
 51  LLAKPCYIVISKRHITMLSIKSGERIVFTFSCQSPENHFVIEIQKNIDCM  100

101  SGPCPFGEVQLQPSTSLLPTLNRTFIWDVKAHKSIGLELQFSIPRLRQIG  150
     ||||||||||||||||||||||||||||||||||||||||||||||||||
101  SGPCPFGEVQLQPSTSLLPTLNRTFIWDVKAHKSIGLELQFSIPRLRQIG  150

151  PGESCPDGVTHSISGRIDATVVRIGTFCSNGTVSRIKMQEGVKMALHLPW  200
     ||||||||||||||||||||||||||||||||||||||||||||||||||
151  PGESCPDGVTHSISGRIDATVVRIGTFCSNGTVSRIKMQEGVKMALHLPW  200

201  FHPRNVSGFSIANRSSIKRLCIIESVFEGEGSATLMSANYPEGFPEDELM  250
     ||||||||||||||||||||||||||||||||||||||||||||||||||
201  FHPRNVSGFSIANRSSIKRLCIIESVFEGEGSATLMSANYPEGFPEDELM  250

251  TWQFVVPAHLRASVSFLNFNLSNCERKEERVEYYIPGSTTNPEVFKLEDK  300
     ||||||||||||||||||||||||||||||||||||||||||||||||||
251  TWQFVVPAHLRASVSFLNFNLSNCERKEERVEYYIPGSTTNPEVFKLEDK  300

301  QPGNMAGNFNLSLQGCDQDAQSPGILRLQFQVLVQHPQNESNKIYVVDLS  350
     ||||||||||||||||||||||||||||||||||||||||||||||||||
301  QPGNMAGNFNLSLQGCDQDAQSPGILRLQFQVLVQHPQNESNKIYVVDLS  350

351  NERAMSLTIEPRPVKQSRKFVPGCFVCLESRTCSSNLTLTSGSKHKISFL  400
     ||||||||||||||||||||||||||||||||||||||||||||||||||
351  QPGNMAGNFNLSLQGCDQDAQSPGILRLQFQVLVQHPQNESNKIYVVDLS  400

401  CDDLTRLWMNVEKTIS                                   416
     ||||||||||||||||
401  CDDLTRLWMNVEKTIS                                   416
```

Sequence name: /tmp/4AUsKD5TnV/TBRg9DoebW: Q96QU7 (SEQ ID NO: 988)

Alignment:

```
  1  MAGLNCGVSIALLGVLLLGAARLPRGAEAFEIALPRESNITVLIKLGTPT   50
     ||||||||||||||||||||||||||||||||||||||||||||||||||
  1  MAGLNCGVSIALLGVLLLGAARLPRGAEAFEIALPRESNITVLIKLGTPT   50

51  LLAKPCYIVISKRHITMLSIKSGERIVFTFSCQSPENHFVIEIQKNIDCM  100
     ||||||||||||||||||||||||||||||||||||||||||||||||||
 51  LLAKPCYIVISKRHITMLSIKSGERIVFTFSCQSPENHFVIEIQKNIDCM  100
```

-continued

```
101  SGPCPFGEVQLQPSTSLLPTLNRTFIWDVKAHKSIGLELQFSIPRLRQIG  150
     ||||||||||||||||||||||||||||||||||||||||||||||||||
101  SGPCPFGEVQLQPSTSLLPTLNRTFIWDVKAHKSIGLELQFSIPRLRQIG  150

151  PGESCPDGVTHSISGRIDATVVRIGTFCSNGTVSRIKMQEGVKMALHLPW  200
     ||||||||||||||||||||||||||||||||||||||||||||||||||
151  PGESCPDGVTHSISGRIDATVVRIGTFCSNGTVSRIKMQEGVKMALHLPW  200

201  FHPRNVSGFSIANRSSIKRLCIIESVFEGEGSATLMSANYPEGFPEDELM  250
     ||||||||||||||||||||||||||||||||||||||||||||||||||
201  FHPRNVSGFSIANRSSIKRLCIIESVFEGEGSATLMSANYPEGFPEDELM  250

251  TWQFVVPAHLRASVSFLNFNLSNCERKEERVEYYIPGSTTNPEVFKLEDK  300
     ||||||||||||||||||||||||||||||||||||||||||||||||||
251  TWQFVVPAHLRASVSFLNFNLSNCERKEERVEYYIPGSTTNPEVFKLEDK  300

301  QPGNMAGNFNLSLQGCDQDAQSPGILRLQFQVLVQHPQNESNKIYVVDLS  350
     ||||||||||||||||||||||||||||||||||||||||||||||||||
301  QPGNMAGNFNLSLQGCDQDAQSPGILRLQFQVLVQHPQNESNKIYVVDLS  350

351  NERAMSLTIEPRPVKQSRKFVPGCFVCLESRTCSSNLTLTSGSKHKISFL  400
     ||||||||||||||||||||||||||||||||||||||||||||||||||
351  QPGNMAGNFNLSLQGCDQDAQSPGILRLQFQVLVQHPQNESNKIYVVDLS  400

401  CDDLTRLWMNVEKTIS  416
     ||||||||||||||||
401  CDDLTRLWMNVEKTIS  416
```

Sequence name: /tmp/IChL9mLIus/pmgyBTHuqO:Q96QU7 (SEQ ID NO: 988)

Sequence documentation:

Alignment of: M77904_P5 (SEQ ID NO: 254) x Q96QU7 (SEQ ID NO: 988) . . .

Alignment segment 1/1:
 Quality: 2285.00

Escore: 0
 Matching length: 231 Total length: 231

Matching Percent Similarity: 100.00 Matching Percent Identity: 100.00
 Total Percent Similarity: 100.00 Total Percent Identity: 100.00
 Gaps: 0

Alignment:

Sequence name: /tmp/IChL9nLIus/pmgyBTHuqO:Q9H8C2 (SEQ ID NO: 990)

Sequence documentation:

Alignment of: M77904_P5 (SEQ ID NO: 254) x Q9H8C2 (SEQ ID NO: 990) . . .

Alignment segment 1/1:
 Quality: 2285.00

Escore: 0
 Matching length: 231 Total length: 231

Matching Percent Similarity: 100.00 Matching Percent Identity: 100.00
 Total Percent Similarity: 100.00 Total Percent Identity: 100.00
 Gaps: 0

```
1    MIIQEQRTRAEEIFSLDEDVLPKPSFHHHSFWVNISNCSPTSGKQLDLLF  50
     ||||||||||||||||||||||||||||||||||||||||||||||||||
606  MIIQEQRTRAEEIFSLDEDVLPKPSFHHHSFWVNISNCSPTSGKQLDLLF  655

51   SVTLTPRTVDLTVILIAAVGGGVLLLSALGLIICCVKKKKKKTNKGPAVG  100
     ||||||||||||||||||||||||||||||||||||||||||||||||||
656  SVTLTPRTVDLTVILIAAVGGGVLLLSALGLIICCVKKKKKKTNKGPAVG  705

101  IYNGNINTEMPRQPKKFQKGRKDNDSHVYAVIEDTMVYGHLLQDSSGSFL  150
     ||||||||||||||||||||||||||||||||||||||||||||||||||
706  IYNGNINTEMPRQPKKFQKGRKDNDSHVYAVIEDTMVYGHLLQDSSGSFL  755

151  QPEVDTYRPFQGTMGVCPPSPPTICSRAPTAKLATEEPPPRSPPESESEP  200
     ||||||||||||||||||||||||||||||||||||||||||||||||||
756  IYNGNINTEMPRQPKKFQKGRKDNDSHVYAVIEDTMVYGHLLQDSSGSFL  805

201  YTFSHPNNGDVSSKDTDIPLLNTQEPMEPAE  231
     ||||||||||||||||||||||||||||||
806  YTFSHPNNGDVSSKDTDIPLLNTQEPMEPAE  836
```

Alignment:

```
  1 MIIQEQRTRAEEIFSLDEDVLPKPSFHHHSFWVNISNCSPTSGKQLDLLF   50
    ||||||||||||||||||||||||||||||||||||||||||||||||||
419 MIIQEQRTRAEEIFSLDEDVLPKPSFHHHSFWVNISNCSPTSGKQLDLLF  468

51 SVTLTPRTVDLTVILIAAVGGGVLLLSALGLIICCVKKKKKKTNKGPAVG  100
    ||||||||||||||||||||||||||||||||||||||||||||||||||
469 SVTLTPRTVDLTVILIAAVGGGVLLLSALGLIICCVKKKKKKTNKGPAVG  518

101 IYNGNINTEMPRQPKKFQKGRKDNDSHVYAVIEDTMVYGHLLQDSSGSFL  150
    ||||||||||||||||||||||||||||||||||||||||||||||||||
519 IYNGNINTEMPRQPKKFQKGRKDNDSHVYAVIEDTMVYGHLLQDSSGSFL  568

151 QPEVDTYRPFQGTMGVCPPSPPTICSRAPTAKLATEEPPPRSPPESESEP  200
    ||||||||||||||||||||||||||||||||||||||||||||||||||
569 IYNGNINTEMPRQPKKFQKGRKDNDSHVYAVIEDTMVYGHLLQDSSGSFL  618

201 YTFSHPNNGDVSSKDTDIPLLNTQEPMEPAE                     231
    |||||||||||||||||||||||||||||||
619 YTFSHPNNGDVSSKDTDIPLLNTQEPMEPAE                     649
```

Sequence name: /tmp/sQqi6hWOGJ/KjbKmDd574: Q8WU91 (SEQ ID NO: 987)

Sequence documentation:

Alignment of: M77904_P7 (SEQ ID NO: 255) x Q8WU91 (SEQ ID NO: 987) . . .

Alignment segment 1/1:
 Quality: 2124.00

Escore: 0
 Matching length: 219 Total length: 219

Matching Percent Similarity: 100.00 Matching Percent Identity: 100.00
 Total Percent Similarity: 100.00 Total Percent Identity: 100.00
 Gaps: 0

Alignment:

Sequence name: /tmp/sQqi6hWOGJ/KjbKmDd574: Q9H5V8 (SEQ ID NO: 989)

Sequence documentation:

Alignment of: M77904_P7 (SEQ ID NO: 255) x Q9H5V8 (SEQ ID NO: 989) . . .

Alignment segment 1/1:
 Quality: 2124.00

Escore: 0
 Matching length: 219 Total length: 219

Matching Percent Similarity: 100.00 Matching Percent Identity: 100.00
 Total Percent Similarity: 100.00 Total Percent Identity: 100.00
 Gaps: 0

```
  1 MAGLNCGVSIALLGVLLLGAARLPRGAEAFEIALPRESNITVLIKLGTPT   50
    ||||||||||||||||||||||||||||||||||||||||||||||||||
  1 MAGLNCGVSIALLGVLLLGAARLPRGAEAFEIALPRESNITVLIKLGTPT   50

51 LLAKPCYIVISKRHITMLSIKSGERIVFTFSCQSPENHFVIEIQKNIDCM  100
    ||||||||||||||||||||||||||||||||||||||||||||||||||
 51 LLAKPCYIVISKRHITMLSIKSGERIVFTFSCQSPENHFVIEIQKNIDCM  100

101 SGPCPFGEVQLQPSTSLLPTLNRTFIWDVKAHKSIGLELQFSIPRLRQIG  150
    ||||||||||||||||||||||||||||||||||||||||||||||||||
101 SGPCPFGEVQLQPSTSLLPTLNRTFIWDVKAHKSIGLELQFSIPRLRQIG  150

151 PGESCPDGVTHSISGRIDATVVRIGTFCSNGTVSRIKMQEGVKMALHLPW  200
    ||||||||||||||||||||||||||||||||||||||||||||||||||
151 PGESCPDGVTHSISGRIDATVVRIGTFCSNGTVSRIKMQEGVKMALHLPW  200

201 FHPRNVSGFSIANRSSIKR                                 219
    |||||||||||||||||||
201 FHPRNVSGFSIANRSSIKR                                 219
```

Alignment:

```
  1  MAGLNCGVSIALLGVLLLGAARLPRGAEAFEIALPRESNITVLIKLGTPT   50
     ||||||||||||||||||||||||||||||||||||||||||||||||||
  1  MAGLNCGVSIALLGVLLLGAARLPRGAEAFEIALPRESNITVLIKLGTPT   50

51  LLAKPCYIVISKRHITMLSIKSGERIVFTFSCQSPENHFVIEIQKNIDCM  100
     ||||||||||||||||||||||||||||||||||||||||||||||||||
 51  LLAKPCYIVISKRHITMLSIKSGERIVFTFSCQSPENHFVIEIQKNIDCM  100

101  SGPCPFGEVQLQPSTSLLPTLNRTFIWDVKAHKSIGLELQFSIPRLRQIG  150
     ||||||||||||||||||||||||||||||||||||||||||||||||||
101  SGPCPFGEVQLQPSTSLLPTLNRTFIWDVKAHKSIGLELQFSIPRLRQIG  150

151  PGESCPDGVTHSISGRIDATVVRIGTFCSNGTVSRIKMQEGVKMALHLPW  200
     ||||||||||||||||||||||||||||||||||||||||||||||||||
151  PGESCPDGVTHSISGRIDATVVRIGTFCSNGTVSRIKMQEGVKMALHLPW  200

201  FHPRNVSGFSIANRSSIKR                                219
     |||||||||||||||||||
201  FHPRNVSGFSIANRSSIKR                                219
```

Sequence name: /tmp/sQqi6hWOGJ/KjbKmDd574: Q96QU7 (SEQ ID NO: 988)

Sequence documentation:

Alignment of: M77904_P7 (SEQ ID NO: 255) x Q96QU7 (SEQ ID NO: 988) . . .

Alignment segment 1/1:
 Quality: 2124.00

Escore: 0
 Matching length: 219 Total length: 219

Matching Percent Similarity: 100.00 Matching Percent

Identity: 100.00
 Total Percent Similarity: 100.00 Total Percent

Identity: 100.00
 Gaps: 0

Alignment:

DESCRIPTION FOR CLUSTER Z25299

Cluster Z25299 features 5 transcript(s) and 11 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| Z25299_PEA_2_T1 | 256 |
| Z25299_PEA_2_T2 | 257 |
| Z25299_PEA_2_T3 | 258 |
| Z25299_PEA_2_T6 | 259 |
| Z25299_PEA_2_T9 | 260 |

```
  1  MAGLNCGVSIALLGVLLLGAARLPRGAEAFEIALPRESNITVLIKLGTPT   50
     ||||||||||||||||||||||||||||||||||||||||||||||||||
  1  MAGLNCGVSIALLGVLLLGAARLPRGAEAFEIALPRESNITVLIKLGTPT   50

51  LLAKPCYIVISKRHITMLSIKSGERIVFTFSCQSPENHFVIEIQKNIDCM  100
     ||||||||||||||||||||||||||||||||||||||||||||||||||
 51  LLAKPCYIVISKRHITMLSIKSGERIVFTFSCQSPENHFVIEIQKNIDCM  100

101  SGPCPFGEVQLQPSTSLLPTLNRTFIWDVKAHKSIGLELQFSIPRLRQIG  150
     ||||||||||||||||||||||||||||||||||||||||||||||||||
101  SGPCPFGEVQLQPSTSLLPTLNRTFIWDVKAHKSIGLELQFSIPRLRQIG  150

151  PGESCPDGVTHSISGRIDATVVRIGTFCSNGTVSRIKMQEGVKMALHLPW  200
     ||||||||||||||||||||||||||||||||||||||||||||||||||
151  PGESCPDGVTHSISGRIDATVVRIGTFCSNGTVSRIKMQEGVKMALHLPW  200

201  FHPRNVSGFSIANRSSIKR                                250
     |||||||||||||||||||
201  FHPRNVSGFSIANRSSIKR                                250
```

TABLE 2

Segments of interest

| Segment Name | SEQ ID NO: |
|---|---|
| Z25299_PEA_2_node_20 | 261 |
| Z25299_PEA_2_node_21 | 262 |
| Z25299_PEA_2_node_23 | 263 |
| Z25299_PEA_2_node_24 | 264 |
| Z25299_PEA_2_node_8 | 265 |
| Z25299_PEA_2_node_12 | 266 |
| Z25299_PEA_2_node_13 | 267 |
| Z25299_PEA_2_node_14 | 268 |
| Z25299_PEA_2_node_17 | 269 |
| Z25299_PEA_2_node_18 | 270 |
| Z25299_PEA_2_node_19 | 271 |

TABLE 3

Proteins of interest

| Protein Name | SEQ ID NO: |
|---|---|
| Z25299_PEA_2_P2 | 273 |
| Z25299_PEA_2_P3 | 274 |
| Z25299_PEA_2_P7 | 275 |
| Z25299_PEA_2_P10 | 276 |

These sequences are variants of the known protein Antileukoproteinase 1 precursor (SwissProt accession identifier ALK1_HUMAN; known also according to the synonyms ALP; HUSI-1; Seminal proteinase inhibitor; Secretory leukocyte protease inhibitor; BLPI; Mucus proteinase inhibitor; MPI; WAP four-disulfide core domain protein 4; Protease inhibitor WAP4), SEQ ID NO: 272, referred to herein as the previously known protein.

Protein Antileukoproteinase 1 precursor is known or believed to have the following function(s): Acid-stable proteinase inhibitor with strong affinities for trypsin, chymotrypsin, elastase, and cathepsin G. May prevent elastase-mediated damage to oral and possibly other mucosal tissues. The sequence for protein Antileukoproteinase 1 precursor is given at the end of the application, as "Antileukoproteinase 1 precursor amino acid sequence". Protein Antileukoproteinase 1 precursor localization is believed to be Secreted.

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Elastase inhibitor; Tryptase inhibitor. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anti-inflammatory; Antiasthma.

The following GO Annotation(s) apply to the previously known protein. The following annotation(s) were found: proteinase inhibitor; serine protease inhibitor, which are annotation(s) related to Molecular Function.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster Z25299 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 25 refer to weighted expression of ESTs in each category, as "parts per million" (ratio of the expression of ESTs for a particular cluster to the expression of all ESTs in that category, according to parts per million).

Figure 25:
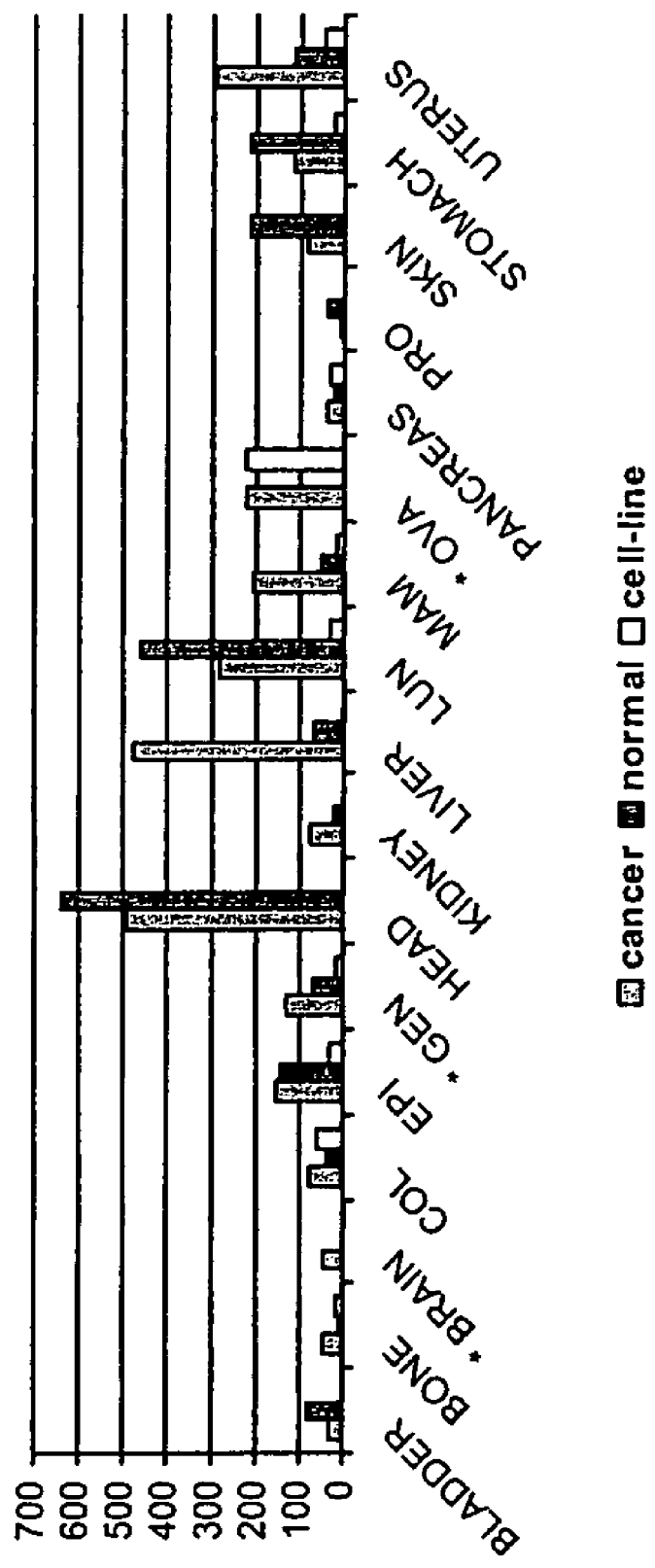
FIG. 25 shows cancer and cell-line vs. normal tissue expression.

Overall, the following results were obtained as shown with regard to the histograms in FIG. 25 and Table 4. This cluster is overexpressed (at least at a minimum level) in the following pathological conditions: brain malignant tumors, a mixture of malignant tumors from different tissues and ovarian carcinoma.

TABLE 4

Normal tissue distribution

| Name of Tissue | Number |
|---|---|
| bladder | 82 |
| bone | 6 |
| brain | 0 |
| colon | 37 |
| epithelial | 145 |
| general | 73 |
| head and neck | 638 |
| kidney | 26 |
| liver | 68 |
| lung | 465 |
| breast | 52 |
| ovary | 0 |
| pancreas | 20 |
| prostate | 36 |
| skin | 215 |
| stomach | 219 |
| uterus | 113 |

TABLE 5

P values and ratios for expression in cancerous tissue

| Name of Tissue | P1 | P2 | SP1 | R3 | SP2 | R4 |
|---|---|---|---|---|---|---|
| bladder | 8.2e−01 | 8.5e−01 | 9.2e−01 | 0.6 | 9.7e−01 | 0.5 |
| bone | 5.5e−01 | 7.3e−01 | 4.0e−01 | 2.1 | 4.9e−01 | 1.5 |
| brain | 8.8e−02 | 1.5e−01 | 2.3e−03 | 7.7 | 1.2e−02 | 4.8 |
| colon | 3.3e−01 | 2.8e−01 | 4.2e−01 | 1.6 | 4.2e−01 | 1.5 |
| epithelial | 2.5e−01 | 7.6e−01 | 3.8e−01 | 1.0 | 1 | 0.6 |
| general | 6.4e−03 | 2.5e−01 | 1.7e−06 | 1.6 | 5.2e−01 | 0.9 |
| head and neck | 3.6e−01 | 5.9e−01 | 7.6e−01 | 0.6 | 1 | 0.3 |
| kidney | 7.4e−01 | 8.4e−01 | 2.1e−01 | 2.1 | 4.2e−01 | 1.4 |
| liver | 4.1e−01 | 9.1e−01 | 4.2e−02 | 3.2 | 6.4e−01 | 0.8 |
| lung | 7.6e−01 | 8.3e−01 | 9.8e−01 | 0.5 | 1 | 0.3 |
| breast | 5.0e−01 | 5.5e−01 | 9.8e−02 | 1.6 | 3.4e−01 | 1.1 |
| ovary | 3.7e−02 | 3.0e−02 | 6.9e−03 | 6.1 | 4.9e−03 | 5.6 |
| pancreas | 3.8e−01 | 3.6e−01 | 3.6e−01 | 1.7 | 3.9e−01 | 1.5 |
| prostate | 9.1e−01 | 9.2e−01 | 8.9e−01 | 0.5 | 9.4e−01 | 0.5 |
| skin | 6.0e−01 | 8.1e−01 | 9.3e−01 | 0.4 | 1 | 0.1 |
| stomach | 3.0e−01 | 8.1e−01 | 9.1e−01 | 0.6 | 1 | 0.3 |
| uterus | 1.6e−01 | 1.3e−01 | 3.2e−02 | 1.6 | 3.0e−01 | 1.1 |

As noted above, cluster Z25299 features 5 transcript(s), which were listed in Table 1 above. These transcript(s) encode for protein(s) which are variant(s) of protein Antileukoproteinase 1 precursor. A description of each variant protein according to the present invention is now provided.

Variant protein Z25299_PEA_2_P2 (SEQ ID NO: 273) according to the present invention has an amino acid sequence as given at the end of the application; it is encoded by transcript(s) Z25299_PEA_2_T1 (SEQ ID NO: 256). An alignment is given to the known protein (Antileukoproteinase 1 precursor) at the end of the application. One or more alignments to one or more previously published protein sequences are given at the end of the application. A brief description of the relationship of the variant protein according to the present invention to each such aligned protein is as follows:

Comparison report between Z25299_PEA_2_P2 (SEQ ID NO: 273) and ALK1_HUMAN:

1. An isolated chimeric polypeptide encoding for Z25299_PEA_2_P2 (SEQ ID NO: 273), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNPTRRK-PGKCPVTYGQCLMLNPPNFCEMDGQCKRDLK CCMGMCGKSCVSPVK corresponding to amino acids 1-131 of ALK1_HUMAN, which also corresponds to amino acids 1-131 of Z25299_PEA_2_P2 (SEQ ID NO: 273), and a second amino acid sequence being at least 70%, optionally at least 80%, preferably at least 85%, more preferably at least 90% and most preferably at least 95% homologous to a polypeptide having the sequence GKQGMRAH (SEQ ID NO: 1138) corresponding to amino acids 132-139 of Z25299_PEA_2_P2 (SEQ ID NO: 273), wherein said first and second amino acid sequences are contiguous and in a sequential order.

2. An isolated polypeptide encoding for a tail of Z25299_PEA_2_P2 (SEQ ID NO: 273), comprising a polypeptide being at least 70%, optionally at least about 80%, preferably at least about 85%, more preferably at least about 90% and most preferably at least about 95% homologous to the sequence GKQGMRAH (SEQ ID NO: 1138) in Z25299_PEA_2_P2 (SEQ ID NO: 273).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z25299_PEA_2_P2 (SEQ ID NO: 273) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein Z25299_PEA_2_P2 (SEQ ID NO: 273) sequence provides support for the deduced sequence of this variant protein according to the present invention).

TABLE 6

Amino acid mutations

| SNP position(s) on amino acid sequence | Alternative amino acid(s) | Previously known SNP? |
| --- | --- | --- |
| 136 | M -> T | Yes |
| 20 | P -> | No |
| 43 | C -> R | No |
| 48 | K -> N | No |
| 83 | R -> K | No |
| 84 | R -> W | No |

Variant protein Z25299_PEA_2_P2 (SEQ ID NO: 273) is encoded by the following transcript(s): Z25299_PEA_2_T1 (SEQ ID NO: 256), for which the sequence(s) is/are given at the end of the application. The coding portion of transcript Z25299_PEA_2_T1 (SEQ ID NO: 256) is shown in bold; this coding portion starts at position 124 and ends at position 540. The transcript also has the following SNPs as listed in Table 7 (given according to their position on the nucleotide sequence, with the alternative nucleic acid listed; the last column indicates whether the SNP is known or not; the presence of known SNPs in variant protein Z25299_PEA_2_P2 (SEQ ID NO: 273) sequence provides support for the deduced sequence of this variant protein according to the present invention).

TABLE 7

Nucleic acid SNPs

| SNP position on nucleotide sequence | Alternative nucleic acid | Previously known SNP? |
| --- | --- | --- |
| 122 | C -> T | No |
| 123 | C -> T | No |
| 530 | T -> C | Yes |
| 989 | C -> T | Yes |
| 1127 | C -> T | Yes |
| 1162 | A -> C | Yes |
| 1180 | A -> C | Yes |
| 1183 | A -> C | Yes |
| 1216 | A -> C | Yes |
| 1262 | G -> A | Yes |
| 183 | T -> | No |
| 250 | T -> C | No |
| 267 | A -> C | No |
| 267 | A -> G | No |
| 339 | C -> T | Yes |
| 371 | G -> A | No |
| 373 | A -> T | No |
| 435 | C -> T | No |

Variant protein Z25299_PEA_2_P3 (SEQ ID NO: 274) according to the present invention has an amino acid sequence as given at the end of the application; it is encoded by transcript(s) Z25299_PEA_2_T2 (SEQ ID NO: 257). An alignment is given to the known protein (Antileukoproteinase 1 precursor) at the end of the application. One or more alignments to one or more previously published protein sequences are given at the end of the application. A brief description of the relationship of the variant protein according to the present invention to each such aligned protein is as follows:

Comparison report between Z25299_PEA_2_P3 (SEQ ID NO: 274) and ALK1_HUMAN:

1. An isolated chimeric polypeptide encoding for Z25299_PEA_2_P3 (SEQ ID NO: 274), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNPTRRK-PGKCPVTYGQCLMLNPPNFCEMDGQCKRDLK CCMGMCGKSCVSPVK corresponding to amino acids 1-131 of ALK1_HUMAN, which also corresponds to amino acids 1-131 of Z25299_PEA_2_P3 (SEQ ID NO: 274), and a second amino acid sequence being at least 70%, optionally at least 80%, preferably at least 85%, more preferably at least 90% and most preferably at least 95% homologous to a polypeptide having the sequence GEKRHHKQLRDQEVD-PLEMRRHSAG (SEQ ID NO: 1139) corresponding to amino acids 132-156 of Z25299_PEA_2_P3 (SEQ ID NO: 274), wherein said first and second amino acid sequences are contiguous and in a sequential order.

2. An isolated polypeptide encoding for a tail of Z25299_PEA_2_P3 (SEQ ID NO: 274), comprising a polypeptide being at least 70%, optionally at least about 80%, preferably at least about 85%, more preferably at least about 90% and most preferably at least about 95% homologous to the sequence GEKRHHKQLRDQEVDPLEMRRHSAG (SEQ ID NO: 1139) in Z25299_PEA_2_P3 (SEQ ID NO: 274).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z25299_PEA_2_P3 (SEQ ID NO: 274) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein Z25299_PEA_2_P3 (SEQ ID NO: 274) sequence provides support for the deduced sequence of this variant protein according to the present invention).

TABLE 8

Amino acid mutations

| SNP position(s) on amino acid sequence | Alternative amino acid(s) | Previously known SNP? |
|---|---|---|
| 20 | P –> | No |
| 43 | C –> R | No |
| 48 | K –> N | No |
| 83 | R –> K | No |
| 84 | R –> W | No |

Variant protein Z25299_PEA_2_P3 (SEQ ID NO: 274) is encoded by the following transcript(s): Z25299_PEA_2_T2 (SEQ ID NO: 257), for which the sequence(s) is/are given at the end of the application. The coding portion of transcript Z25299_PEA_2_T2 (SEQ ID NO: 257) is shown in bold; this coding portion starts at position 124 and ends at position 591. The transcript also has the following SNPs as listed in Table 9 (given according to their position on the nucleotide sequence, with the alternative nucleic acid listed; the last column indicates whether the SNP is known or not; the presence of known SNPs in variant protein Z25299_PEA_2_P3 (SEQ ID NO: 274) sequence provides support for the deduced sequence of this variant protein according to the present invention).

TABLE 9

Nucleic acid SNPs

| SNP position on nucleotide sequence | Alternative nucleic acid | Previously known SNP? |
|---|---|---|
| 122 | C –> T | No |
| 123 | C –> T | No |
| 183 | T –> | No |
| 250 | T –> C | No |
| 267 | A –> C | No |
| 267 | A –> G | No |
| 339 | C –> T | Yes |
| 371 | G –> A | No |
| 373 | A –> T | No |
| 435 | C –> T | No |

Variant protein Z25299_PEA_2_P7 (SEQ ID NO: 275) according to the present invention has an amino acid sequence as given at the end of the application; it is encoded by transcript(s) Z25299_PEA_2_T6 (SEQ ID NO: 259). An alignment is given to the known protein (Antileukoproteinase 1 precursor) at the end of the application. One or more alignments to one or more previously published protein sequences are given at the end of the application. A brief description of the relationship of the variant protein according to the present invention to each such aligned protein is as follows:

Comparison report between Z25299_PEA_2_P7 (SEQ ID NO: 275) and ALK1_HUMAN:

1. An isolated chimeric polypeptide encoding for Z25299_PEA_2_P7 (SEQ ID NO: 275), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNP corresponding to amino acids 1-81 of ALK1_HUMAN, which also corresponds to amino acids 1-81 of Z25299_PEA_2_P7 (SEQ ID NO: 275), and a second amino acid sequence being at least 70%, optionally at least 80%, preferably at least 85%, more preferably at least 90% and most preferably at least 95% homologous to a polypeptide having the sequence RGSLGSAQ (SEQ ID NO: 1140) corresponding to amino acids 82-89 of Z25299_PEA_2_P7 (SEQ ID NO: 275), wherein said first and second amino acid sequences are contiguous and in a sequential order.

2. An isolated polypeptide encoding for a tail of Z25299_PEA_2_P7 (SEQ ID NO: 275), comprising a polypeptide being at least 70%, optionally at least about 80%, preferably at least about 85%, more preferably at least about 90% and most preferably at least about 95% homologous to the sequence RGSLGSAQ (SEQ ID NO: 1140) in Z25299_PEA_2_P7 (SEQ ID NO: 275).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z25299_PEA_2_P7 (SEQ ID NO: 275) also has the following non-silent SNPs (Single Nucleotide Polymorphisms) as listed in Table 10, (given according to their position(s) on the amino acid sequence, with the alternative amino acid(s) listed; the last column indicates whether the SNP is known or not; the presence of known SNPs in variant protein Z25299_PEA_2_P7 (SEQ ID NO: 275) sequence provides support for the deduced sequence of this variant protein according to the present invention).

TABLE 10

Amino acid mutations

| SNP position(s) on amino acid sequence | Alternative amino acid(s) | Previously known SNP? |
|---|---|---|
| 20 | P –> | No |
| 43 | C –> R | No |
| 48 | K –> N | No |
| 82 | R –> S | No |

Variant protein Z25299_PEA_2_P7 (SEQ ID NO: 275) is encoded by the following transcript(s): Z25299_PEA_2_T6 (SEQ ID NO: 259), for which the sequence(s) is/are given at the end of the application. The coding portion of transcript Z25299_PEA_2_T6 (SEQ ID NO: 259) is shown in bold; this coding portion starts at position 124 and ends at position 390. The transcript also has the following SNPs as listed in Table 11 (given according to their position on the nucleotide sequence, with the alternative nucleic acid listed; the last column indicates whether the SNP is known or not; the presence of known SNPs in variant protein Z25299_PEA_2_P7 (SEQ ID NO: 275) sequence provides support for the deduced sequence of this variant protein according to the present invention).

TABLE 11

Nucleic acid SNPs

| SNP position on nucleotide sequence | Alternative nucleic acid | Previously known SNP? |
|---|---|---|
| 122 | C -> T | No |
| 123 | C -> T | No |
| 576 | A -> C | Yes |
| 594 | A -> C | Yes |
| 597 | A -> C | Yes |
| 630 | A -> C | Yes |
| 676 | G -> A | Yes |
| 183 | T -> | No |
| 250 | T -> C | No |
| 267 | A -> C | No |
| 267 | A -> G | No |
| 339 | C -> T | Yes |
| 369 | A -> T | No |
| 431 | C -> T | No |
| 541 | C -> T | Yes |

Variant protein Z25299_PEA_2_P10 (SEQ ID NO: 276) according to the present invention has an amino acid sequence as given at the end of the application; it is encoded by transcript(s) Z25299_PEA_2_T9 (SEQ ID NO: 260). An alignment is given to the known protein (Antileukoproteinase 1 precursor) at the end of the application. One or more alignments to one or more previously published protein sequences are given at the end of the application. A brief description of the relationship of the variant protein according to the present invention to each such aligned protein is as follows:

Comparison report between Z25299_PEA_2_P10 (SEQ ID NO: 276) and ALK1_HUMAN:

1. An isolated chimeric polypeptide encoding for Z25299_PEA_2_P10 (SEQ ID NO: 276), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNPT corresponding to amino acids 1-82 of ALK1_HUMAN, which also corresponds to amino acids 1-82 of Z25299_PEA_2_P10 (SEQ ID NO: 276).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z25299_PEA_2_P10 (SEQ ID NO: 276) also has the following non-silent SNPs (Single Nucleotide Polymorphisms) as listed in Table 12, (given according to their position(s) on the amino acid sequence, with the alternative amino acid(s) listed; the last column indicates whether the SNP is known or not; the presence of known SNPs in variant protein Z25299_PEA_2_P10 (SEQ ID NO: 276) sequence provides support for the deduced sequence of this variant protein according to the present invention).

TABLE 12

Amino acid mutations

| SNP position(s) on amino acid sequence | Alternative amino acid(s) | Previously known SNP? |
|---|---|---|
| 20 | P -> | No |
| 43 | C -> R | No |
| 48 | K -> N | No |

Variant protein Z25299_PEA_2_P10 (SEQ ID NO: 276) is encoded by the following transcript(s): Z25299_PEA_2_T9 (SEQ ID NO: 260), for which the sequence(s) is/are given at the end of the application. The coding portion of transcript Z25299_PEA_2_T9 (SEQ ID NO: 260) is shown in bold; this coding portion starts at position 124 and ends at position 369. The transcript also has the following SNPs as listed in Table 13 (given according to their position on the nucleotide sequence, with the alternative nucleic acid listed; the last column indicates whether the SNP is known or not; the presence of known SNPs in variant protein Z25299_PEA_2_P10 (SEQ ID NO: 276) sequence provides support for the deduced sequence of this variant protein according to the present invention).

TABLE 13

Nucleic acid SNPs

| SNP position on nucleotide sequence | Alternative nucleic acid | Previously known SNP? |
|---|---|---|
| 122 | C -> T | No |
| 123 | C -> T | No |
| 451 | A -> C | Yes |
| 484 | A -> C | Yes |
| 530 | G -> A | Yes |
| 183 | T -> | No |
| 250 | T -> C | No |
| 267 | A -> C | No |
| 267 | A -> G | No |
| 339 | C -> T | Yes |
| 395 | C -> T | Yes |
| 430 | A -> C | Yes |
| 448 | A -> C | Yes |

As noted above, cluster Z25299 features 11 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster Z25299_PEA_2_node_20 (SEQ ID NO: 261) according to the present invention is supported by 6 libraries. The number of libraries was determined as previously described. This segment can be found in the following transcript(s): Z25299_PEA_2_T1 (SEQ ID NO: 256). Table 14 below describes the starting and ending position of this segment on each transcript.

TABLE 14

Segment location on transcripts

| Transcript name | Segment starting position | Segment ending position |
|---|---|---|
| Z25299_PEA_2_T1 (SEQ ID NO:256) | 518 | 1099 |

Segment cluster Z25299_PEA_2_node_21 (SEQ ID NO: 262) according to the present invention is supported by 162 libraries. The number of libraries was determined as previously described. This segment can be found in the following transcript(s): Z25299_PEA_2_T1 (SEQ ID NO: 256), Z25299_PEA_2_T6 (SEQ ID NO: 259) and Z25299_PEA_2_T9 (SEQ ID NO: 260). Table 15 below describes the starting and ending position of this segment on each transcript.

TABLE 15

Segment location on transcripts

| Transcript name | Segment starting position | Segment ending position |
|---|---|---|
| Z25299_PEA_2_T1 (SEQ ID NO:256) | 1100 | 1292 |
| Z25299_PEA_2_T6 (SEQ ID NO:259) | 514 | 706 |
| Z25299_PEA_2_T9 (SEQ ID NO:260) | 368 | 560 |

Segment cluster Z25299_PEA_2_node_23 (SEQ ID NO: 263) according to the present invention is supported by 2 libraries. The number of libraries was determined as previously described. This segment can be found in the following transcript(s): Z25299_PEA_2_T2 (SEQ ID NO: 257). Table 16 below describes the starting and ending position of this segment on each transcript.

TABLE 16

Segment location on transcripts

| Transcript name | Segment starting position | Segment ending position |
|---|---|---|
| Z25299_PEA_2_T2 (SEQ ID NO:257) | 518 | 707 |

Segment cluster Z25299_PEA_2_node_24 (SEQ ID NO: 264) according to the present invention is supported by 2 libraries. The number of libraries was determined as previously described. This segment can be found in the following transcript(s): Z25299_PEA_2_T2 (SEQ ID NO: 257) and Z25299_PEA_2_T3 (SEQ ID NO: 258). Table 17 below describes the starting and ending position of this segment on each transcript.

TABLE 17

Segment location on transcripts

| Transcript name | Segment starting position | Segment ending position |
|---|---|---|
| Z25299_PEA_2_T2 (SEQ ID NO:257) | 708 | 886 |
| Z25299_PEA_2_T3 (SEQ ID NO:258) | 518 | 696 |

Segment cluster Z25299_PEA_2_node_8 (SEQ ID NO: 265) according to the present invention is supported by 218 libraries. The number of libraries was determined as previously described. This segment can be found in the following transcript(s): Z25299_PEA_2_T1 (SEQ ID NO: 256), Z25299_PEA_2_T2 (SEQ ID NO: 257), Z25299_PEA_2_T3 (SEQ ID NO: 258), Z25299_PEA_2_T6 (SEQ ID NO: 259) and Z25299_PEA_2_T9 (SEQ ID NO: 260). Table 18 below describes the starting and ending position of this segment on each transcript.

TABLE 18

Segment location on transcripts

| Transcript name | Segment starting position | Segment ending position |
|---|---|---|
| Z25299_PEA_2_T1 (SEQ ID NO:256) | 1 | 208 |
| Z25299_PEA_2_T2 (SEQ ID NO:257) | 1 | 208 |
| Z25299_PEA_2_T3 (SEQ ID NO:258) | 1 | 208 |
| Z25299_PEA_2_T6 (SEQ ID NO:259) | 1 | 208 |
| Z25299_PEA_2_T9 (SEQ ID NO:260) | 1 | 208 |

Microarray (chip) data is also available for this segment as follows. As described above with regard to the cluster itself, various oligonucleotides were tested for being differentially expressed in various disease conditions, particularly cancer. The following oligonucleotides were found to hit this segment (with regard to ovarian cancer), shown in Table 19.

TABLE 19

Oligonucleotides related to this segment

| Oligonucleotide name | Overexpressed in cancers | Chip reference |
|---|---|---|
| Z25299_0_3_0 (SEQ ID NO:1017) | ovarian carcinoma | OVA |

According to an optional embodiment of the present invention, short segments related to the above cluster are also provided. These segments are up to about 120 bp in length, and so are included in a separate description.

Segment cluster Z25299_PEA_2_node_12 (SEQ ID NO: 266) according to the present invention is supported by 228 libraries. The number of libraries was determined as previously described. This segment can be found in the following transcript(s): Z25299_PEA_2_T1 (SEQ ID NO: 256), Z25299_PEA_2_T2 (SEQ ID NO: 257), Z25299_PEA_2_T3 (SEQ ID NO: 258), Z25299_PEA_2_T6 (SEQ ID NO: 259) and Z25299_PEA_2_T9 (SEQ ID NO: 260). Table 20 below describes the starting and ending position of this segment on each transcript.

TABLE 20

Segment location on transcripts

| Transcript name | Segment starting position | Segment ending position |
|---|---|---|
| Z25299_PEA_2_T1 (SEQ ID NO:256) | 209 | 245 |
| Z25299_PEA_2_T2 (SEQ ID NO:257) | 209 | 245 |
| Z25299_PEA_2_T3 (SEQ ID NO:258) | 209 | 245 |
| Z25299_PEA_2_T6 (SEQ ID NO:259) | 209 | 245 |
| Z25299_PEA_2_T9 (SEQ ID NO:260) | 209 | 245 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to ovarian cancer), shown in Table 21.

TABLE 21

Oligonucleotides related to this segment

| Oligonucleotide name | Overexpressed in cancers | Chip reference |
|---|---|---|
| Z25299_0_3_0 (SEQ ID NO:1017) | ovarian carcinoma | OVA |

Segment cluster Z25299_PEA_2_node_13 (SEQ ID NO: 267) according to the present invention is supported by 246 libraries. The number of libraries was determined as previously described. This segment can be found in the following transcript(s): Z25299_PEA_2_T1 (SEQ ID NO: 256), Z25299_PEA_2_T2 (SEQ ID NO: 257), Z25299_PEA_2_T3 (SEQ ID NO: 258), Z25299_PEA_2_T6 (SEQ ID NO: 259) and Z25299_PEA_2_T9 (SEQ ID NO: 260). Table 22 below describes the starting and ending position of this segment on each transcript.

TABLE 22

Segment location on transcripts

| Transcript name | Segment starting position | Segment ending position |
|---|---|---|
| Z25299_PEA_2_T1 (SEQ ID NO:256) | 246 | 357 |
| Z25299_PEA_2_T2 (SEQ ID NO:257) | 246 | 357 |
| Z25299_PEA_2_T3 (SEQ ID NO:258) | 246 | 357 |
| Z25299_PEA_2_T6 (SEQ ID NO:259) | 246 | 357 |
| Z25299_PEA_2_T9 (SEQ ID NO:260) | 246 | 357 |

Segment cluster Z25299_PEA_2_node_14 (SEQ ID NO: 268) Z25299_PEA_2_node_14 (SEQ ID NO: 268) (SEQ ID NO: 268) according to the present invention can be found in the following transcript(s): Z25299_PEA_2_T1 (SEQ ID NO: 256), Z25299_PEA_2_T2 (SEQ ID NO: 257), Z25299_PEA_2_T3 (SEQ ID NO: 258), Z25299_PEA_2_T6 (SEQ ID NO: 259) and Z25299_PEA_2_T9 (SEQ ID NO: 260). Table 23 below describes the starting and ending position of this segment on each transcript.

TABLE 23

Segment location on transcripts

| Transcript name | Segment starting position | Segment ending position |
|---|---|---|
| Z25299_PEA_2_T1 (SEQ ID NO:256) | 358 | 367 |
| Z25299_PEA_2_T2 (SEQ ID NO:257) | 358 | 367 |
| Z25299_PEA_2_T3 (SEQ ID NO:258) | 358 | 367 |
| Z25299_PEA_2_T6 (SEQ ID NO:259) | 358 | 367 |
| Z25299_PEA_2_T9 (SEQ ID NO:260) | 358 | 367 |

Segment cluster Z25299_PEA_2_node_17 (SEQ ID NO: 269) according to the present invention can be found in the following transcript(s): Z25299_PEA_2_T1 (SEQ ID NO: 256), Z25299_PEA_2_T2 (SEQ ID NO: 257) and Z25299_PEA_2_T3 (SEQ ID NO: 258). Table 24 below describes the starting and ending position of this segment on each transcript.

TABLE 24

Segment location on transcripts

| Transcript name | Segment starting position | Segment ending position |
|---|---|---|
| Z25299_PEA_2_T1 (SEQ ID NO:256) | 368 | 371 |
| Z25299_PEA_2_T2 (SEQ ID NO:257) | 368 | 371 |
| Z25299_PEA_2_T3 (SEQ ID NO:258) | 368 | 371 |

Segment cluster Z25299_PEA_2_node_18 (SEQ ID NO: 270) according to the present invention is supported by 221 libraries. The number of libraries was determined as previously described. This segment can be found in the following transcript(s): Z25299_PEA_2_T1 (SEQ ID NO: 256), Z25299_PEA_2_T2 (SEQ ID NO: 257), Z25299_PEA_2_T3 (SEQ ID NO: 258) and Z25299_PEA_2_T6 (SEQ ID NO: 259). Table 25 below describes the starting and ending position of this segment on each transcript.

TABLE 25

Segment location on transcripts

| Transcript name | Segment starting position | Segment ending position |
|---|---|---|
| Z25299_PEA_2_T1 (SEQ ID NO:256) | 372 | 427 |
| Z25299_PEA_2_T2 (SEQ ID NO:257) | 372 | 427 |

TABLE 25-continued

Segment location on transcripts

| Transcript name | Segment starting position | Segment ending position |
|---|---|---|
| Z25299_PEA_2_T3 (SEQ ID NO:258) | 372 | 427 |
| Z25299_PEA_2_T6 (SEQ ID NO:259) | 368 | 423 |

Segment cluster Z25299_PEA_2_node_19 (SEQ ID NO: 271) according to the present invention is supported by 197 libraries. The number of libraries was determined as previously described. This segment can be found in the following transcript(s): Z25299_PEA_2_T1 (SEQ ID NO: 256), Z25299_PEA_2_T2 (SEQ ID NO: 257), Z25299_PEA_2_T3 (SEQ ID NO: 258) and Z25299_PEA_2_T6 (SEQ ID NO: 259). Table 26 below describes the starting and ending position of this segment on each transcript.

TABLE 26

Segment location on transcripts

| Transcript name | Segment starting position | Segment ending position |
|---|---|---|
| Z25299_PEA_2_T1 (SEQ ID NO:256) | 428 | 517 |
| Z25299_PEA_2_T2 (SEQ ID NO:257) | 428 | 517 |
| Z25299_PEA_2_T3 (SEQ ID NO:258) | 428 | 517 |
| Z25299_PEA_2_T6 (SEQ ID NO:259) | 424 | 513 |

Variant protein alignment to the previously known protein:

Sequence name: /tmp/oXgeQ4MeyL/K6Vqb1MQu2: ALK1_HUMAN

Sequence documentation:

Alignment of: Z25299_PEA_2_P2 (SEQ ID NO: 273) x ALK1_HUMAN . . .

Alignment segment 1/1:
  Quality: 1371.00

Escore: 0
  Matching length: 131 Total length: 131
  Matching Percent Similarity: 100.00 Matching Percent Identity: 100.00
  Total Percent Similarity: 100.00 Total Percent Identity: 100.00
  Gaps: 0

Alignment:

```
  1 MKSSGLFPFLVLLALGTLAPWAVEGSGKSFKAGVCPPKKSAQCLRYKKPE   50
    |||||||||||||||||||||||||||||||||||||||||||||||||||
  1 MKSSGLFPFLVLLALGTLAPWAVEGSGKSFKAGVCPPKKSAQCLRYKKPE   50

51 CQSDWQCPGKKRCCPDTCGIKCLDPVDTPNPTRRKPGKCPVTYGQCLMLN  100
    |||||||||||||||||||||||||||||||||||||||||||||||||||
 51 CQSDWQCPGKKRCCPDTCGIKCLDPVDTPNPTRRKPGKCPVTYGQCLMLN  100

101 PPNFCEMDGQCKRDLKCCMGMCGKSCVSPVK                    131
    |||||||||||||||||||||||||||||||
101 PPNFCEMDGQCKRDLKCCMGMCGKSCVSPVK                    131
```

Sequence name: /tmp/rbf314VLIm/yR4314SbP4: ALK1_HUMAN

Sequence documentation:

Alignment of: Z25299_PEA_2_P3 (SEQ ID NO: 274) x ALK1_HUMAN . . .

Alignment segment 1/1:
  Quality: 1371.00

Escore: 0
  Matching length: 131 Total length: 131

Matching Percent Similarity: 100.00 Matching Percent

Identity: 100.00
  Total Percent Similarity: 100.00 Total Percent

Identity: 100.00
  Gaps: 0

Alignment:

```
  1 MKSSGLFPFLVLLALGTLAPWAVEGSGKSFKAGVCPPKKSAQCLRYKKPE   50
    ||||||||||||||||||||||||||||||||||||||||||||||||||
  1 MKSSGLFPFLVLLALGTLAPWAVEGSGKSFKAGVCPPKKSAQCLRYKKPE   50

51 CQSDWQCPGKKRCCPDTCGIKCLDPVDTPNPTRRKPGKCPVTYGQCLMLN  100
    ||||||||||||||||||||||||||||||||||||||||||||||||||
 51 CQSDWQCPGKKRCCPDTCGIKCLDPVDTPNPTRRKPGKCPVTYGQCLMLN  100

101 PPNFCEMDGQCKRDLKCCMGMCGKSCVSPVK                     131
    ||||||||||||||||||||||||||||||
101 PPNFCEMDGQCKRDLKCCMGMCGKSCVSPVK                     131
```

Sequence name: /tmp/KCtSXACZXe/rK4T6LKeRX: ALK1_HUMAN

Sequence documentation:

Alignment of: Z25299_PEA_2_P7 (SEQ ID NO: 275) x ALK1_HUMAN . . .

Alignment segment 1/1:
  Quality: 835.00
Escore: 0
  Matching length: 81 Total length: 81
Matching Percent Similarity: 100.00 Matching Percent Identity: 100.00
  Total Percent Similarity: 100.00 Total Percent Identity: 100.00
  Gaps: 0

Alignment:

```
  1 MKSSGLFPFLVLLALGTLAPWAVEGSGKSFKAGVCPPKKSAQCLRYKKPE   50
    ||||||||||||||||||||||||||||||||||||||||||||||||||
  1 MKSSGLFPFLVLLALGTLAPWAVEGSGKSFKAGVCPPKKSAQCLRYKKPE   50

51 CQSDWQCPGKKRCCPDTCGIKCLDPVDTPNP                      81
    |||||||||||||||||||||||||||||||
 51 CQSDWQCPGKKRCCPDTCGIKCLDPVDTPNP                      81
```

Sequence name: /tmp/LcBlcAxB6c/NSI9pqfxoU: ALK1_HUMAN

Sequence documentation:

Alignment of: Z25299_PEA_2_P10 (SEQ ID NO: 276) x ALK1_HUMAN . . .

Alignment segment 1/1:
  Quality: 844.00
Escore: 0
  Matching length: 82 Total length: 82
Matching Percent Similarity: 100.00 Matching Percent Identity: 100.00
  Total Percent Similarity: 100.00 Total Percent Identity: 100.00
  Gaps: 0

Alignment:

```
  1 MKSSGLFPFLVLLALGTLAPWAVEGSGKSFKAGVCPPKKSAQCLRYKKPE   50
    ||||||||||||||||||||||||||||||||||||||||||||||||||
  1 MKSSGLFPFLVLLALGTLAPWAVEGSGKSFKAGVCPPKKSAQCLRYKKPE   50

51 CQSDWQCPGKKRCCPDTCGIKCLDPVDTPNPT                     82
    ||||||||||||||||||||||||||||||||
 51 CQSDWQCPGKKRCCPDTCGIKCLDPVDTPNPT                     82
```

Expression of Secretory Leukocyte Protease Inhibitor Acid-Stable Proteinase Inhibitor Z25299 Transcripts which are Detectable by Amplicon as Depicted in Sequence Name Z25299 junc13-14-21 (SEQ ID NO:993) in Normal and Cancerous Ovary Tissues Expression of Secretory leukocyte protease inhibitor Acid-stable proteinase inhibitor transcripts detectable by or according to junc13-14-21, Z25299 junc13-14-21 (SEQ ID NO:993) amplicon(s) and Z25299 junc13-14-21F (SEQ ID NO:991) and Z25299 junc13-14-21R (SEQ ID NO:992) primers was measured by real time PCR. In parallel the expression of four housekeeping genes —PBGD (GenBank Accession No. BC019323, (SEQ ID NO:1036); amplicon—PBGD-amplicon, (SEQ ID NO:1039)), HPRT1 (GenBank Accession No. NM_000194, (SEQ ID NO:1040); amplicon—HPRT1-amplicon, (SEQ ID NO:1043)), SDHA (GenBank Accession No. NM_004168, (SEQ ID NO: 1032); amplicon—SDHA-amplicon, (SEQ ID NO:1035)), and GAPDH (GenBank Accession No. BC026907, (SEQ ID NO:1044); GAPDH amplicon, (SEQ ID NO: 1047)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45-48, 71, Table 1, "Tissue samples in testing panel", above), to obtain a value of fold up-regulation for each sample relative to median of the normal PM samples.

Figure 26:
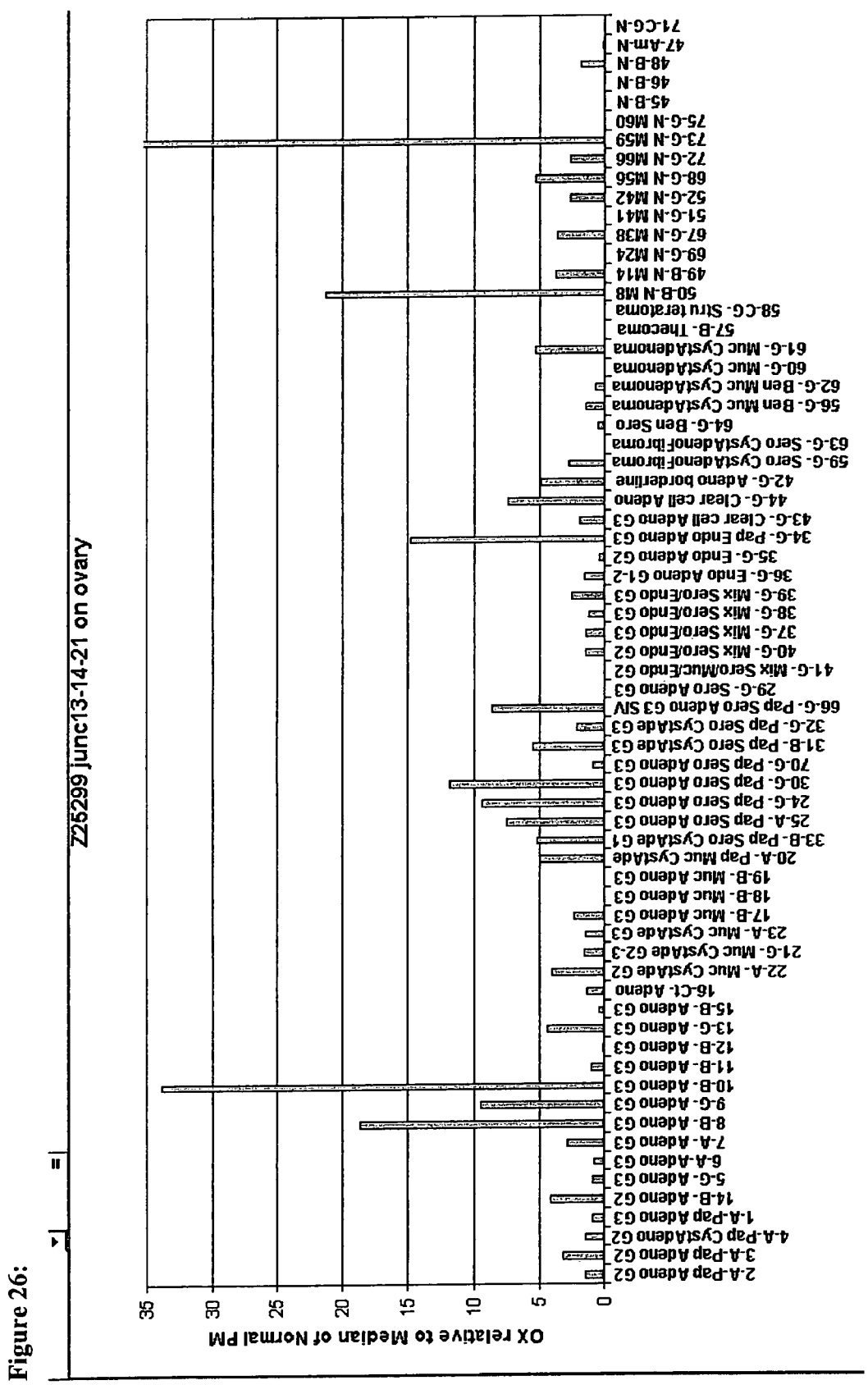
FIG. 26 is a histogram showing over expression of Z25299 junc13-14-21 (SEQ ID NO:993) transcripts in cancerous ovary samples relative to the normal samples.

FIG. 26 is a histogram showing over expression of the above-indicated Secretory leukocyte protease inhibitor Acid-stable proteinase inhibitor transcripts in cancerous ovary samples relative to the normal samples. The number and percentage of samples that exhibit at least 5 fold over-expression, out of the total number of samples tested is indicated in the bottom.

As is evident from FIG. 26, the expression of Secretory leukocyte protease inhibitor Acid-stable proteinase inhibitor transcripts detectable by the above amplicon(s) in cancer samples was significantly higher than in the non-cancerous samples (Sample Nos. 45-48, 71, Table 1, "Tissue samples in testing panel"). Notably an over-expression of at least 5 fold was found in 12 out of 42 adenocarcinoma samples.

Statistical analysis was applied to verify the significance of these results, as described below. The P value for the difference in the expression levels of Secretory leukocyte protease inhibitor Acid-stable proteinase inhibitor transcripts detectable by the above amplicon(s) in ovary cancer samples versus the normal tissue samples was determined by T test as 3.0E-04. The above value demonstrates statistical significance of the results.

Primer pairs are also optionally and preferably encompassed within the present invention; for example, for the above experiment, the following primer pair was used as a non-limiting illustrative example only of a suitable primer pair: Z25299 junc13-14-21F (SEQ ID NO:991) forward primer; and Z25299 junc13-14-21R (SEQ ID NO:992) reverse primer.

The present invention also preferably encompasses any amplicon obtained through the use of any suitable primer pair; for example, for the above experiment, the following amplicon was obtained as a non-limiting illustrative example only of a suitable amplicon: Z25299 junc13-14-21 (SEQ ID NO:993).

Z25299 junc13-14-21 Forward primer (SEQ ID NO:991): ACCCCAAACCCAACTTGATTC

Z25299junc13-14-21 Reverse primer (SEQ ID NO:992): TCAGTGGTGGAGCCAAGTCTC

Z25299 junc13-14-21 Amplicon (SEQ ID NO:993): ACCCCAAACCCAACTTGATTCCTGCCATATGGAGGAGGCTCTGGAGTCCTGCTCTGTGTGGTCCAGGTCCTTTCCACCCTGAGACTTGGCTCCACCACTGA Expression of Secretory Leukocyte Protease Inhibitor Acid-Stable Proteinase Inhibitor Z25299 Transcripts, which are Detectable by Amplicon as Depicted in Sequence Name Z25299 seg20 (SEQ ID NO:996) in Normal and Cancerous Ovary Tissues Expression of Secretory leukocyte protease inhibitor Acid-stable proteinase inhibitor transcripts detectable by or according to seg20, Z25299 seg20 amplicon(s) (SEQ ID NO:996) and Z25299 seg20F (SEQ ID NO:994) and Z25299 seg20R (SEQ ID NO:995) primers was measured by real time PCR. In parallel the expression of four housekeeping genes —PBGD (GenBank Accession No. BC019323, (SEQ ID NO:1036); amplicon—PBGD-amplicon, (SEQ ID NO:1039)), HPRT1 (GenBank Accession No. NM_000194, (SEQ ID NO:1040); amplicon—HPRT1-amplicon, (SEQ ID NO:1043)), SDHA (GenBank Accession No. NM_004168, (SEQ ID NO:1032); amplicon—SDHA-amplicon, (SEQ ID NO:1035)), and GAPDH (GenBank Accession No. BC026907, (SEQ ID NO:1044); GAPDH amplicon, (SEQ ID NO:1047)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45-48, 71, Table 1, "Tissue samples in testing panel" above), to obtain a value of fold up-regulation for each sample relative to median of the normal PM samples.

Figure 27A:
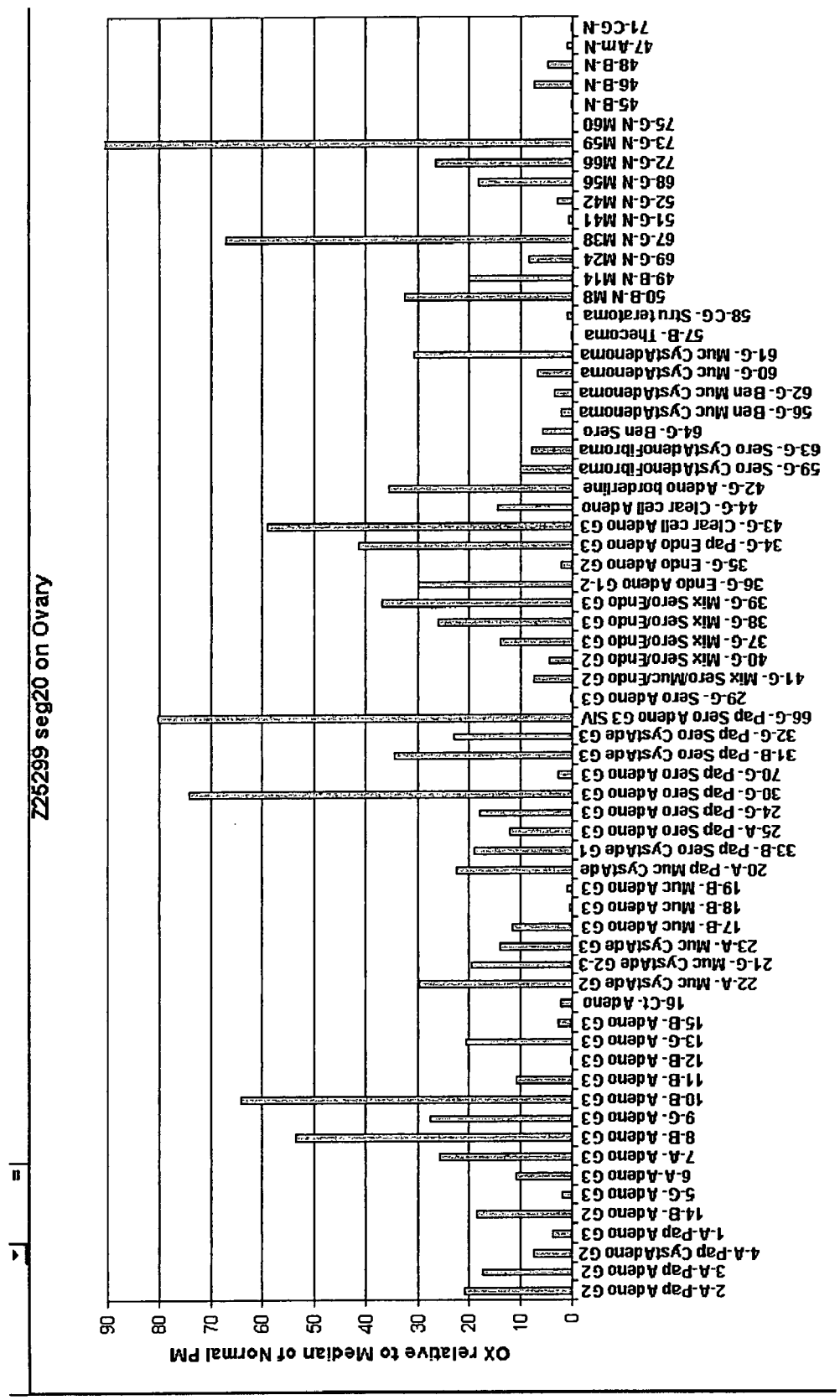
FIGS. 27A and 27B are histograms showing over expression of Z25299 seg20 (SEQ ID NO:996) transcripts in cancerous ovary samples relative to the normal samples (27A) or in normal tissues (27B).

FIG. 27A is a histogram showing over expression of the above-indicated Secretory leukocyte protease inhibitor Acid-stable proteinase transcripts in cancerous ovary samples relative to the normal samples. As is evident from FIG. 27A, the expression of Secretory leukocyte protease inhibitor Acid-stable proteinase transcripts detectable by the above amplicon(s) in cancer samples was significantly higher than in the non-cancerous samples (Sample Nos. 45-48, 71, Table 1, "Tissue samples in testing panel"). Notably an over-expression of at least 10 fold was found in 30 out of 43 adenocarcinoma samples.

Statistical analysis was applied to verify the significance of these results, as described below. The P value for the difference in the expression levels of Secretory leukocyte protease inhibitor Acid-stable proteinase inhibitor transcripts detectable by the above amplicon(s) in ovary cancer samples versus the normal tissue samples was determined by T test as 9.81E-07. Threshold of 10 fold overexpression was found to differentiate between cancer and normal samples with P value of 5E-03 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: Z25299 seg20F forward primer; and Z25299 seg20R reverse primer.

The present invention also preferably encompasses any amplicon obtained through the use of any suitable primer pair; for example, for the above experiment, the following amplicon was obtained as a non-limiting illustrative example only of a suitable amplicon: Z25299 seg20.

Z25299 seg20 Forward primer (SEQ ID NO:994): CTCCTGAACCCTACTCCAAGCA

Z25299 seg20 Reverse primer (SEQ ID NO:995): CAGGCGATCCTATGGAAATCC

Z25299 seg20 Amplicon (SEQ ID NO:996): CTCCTGAACCCTACTCCAAGCACAGCCTCT-

GTCTGACTCCCTTGTCCTTCAAGAGAA CTGTTCTC-
CAGGTCTCAGGGCCAGGATTTCCATAGGATCGCCTG

Figure 27B:
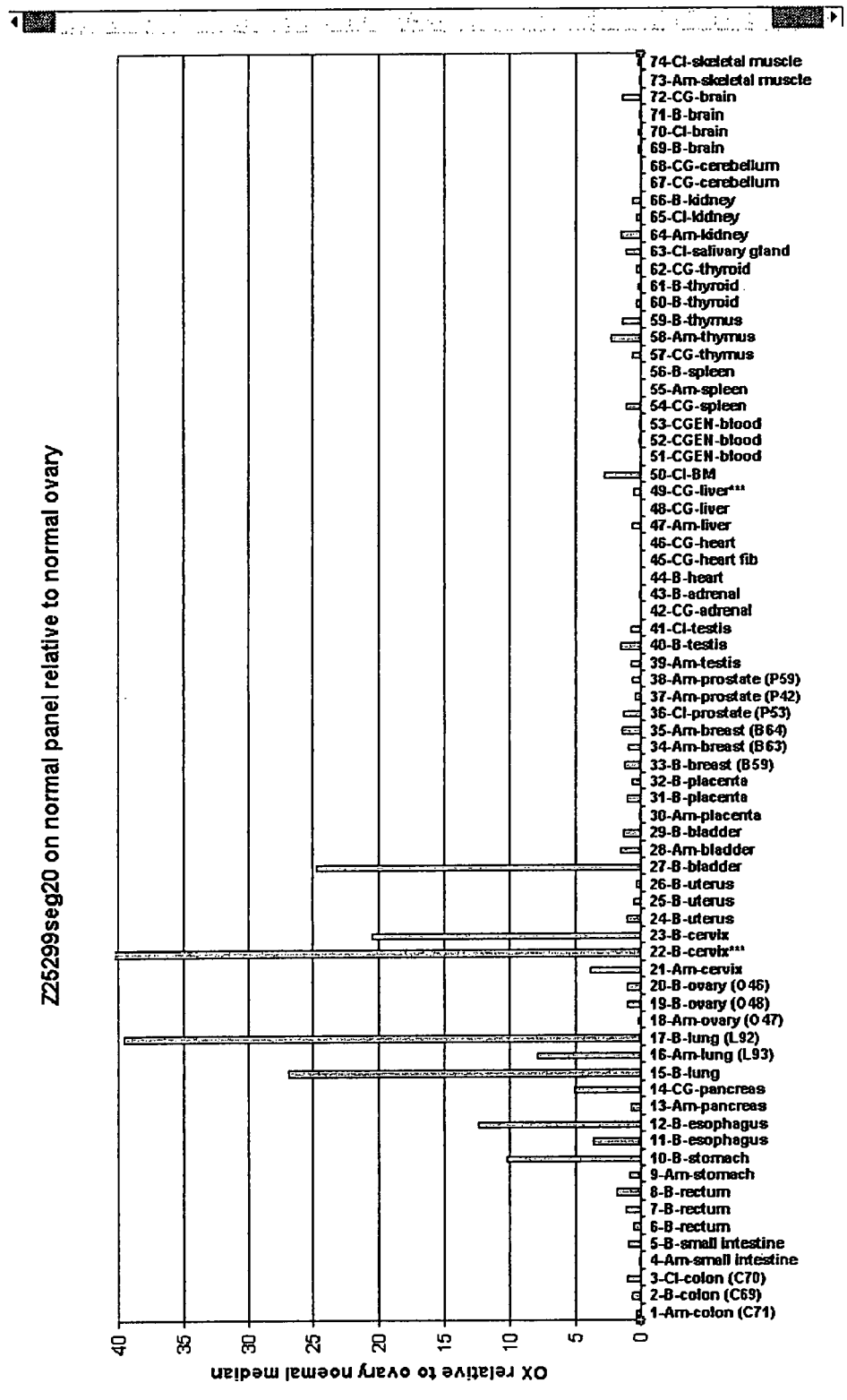

Expression of Secretory Leukocyte Protease Inhibitor (Acid-Stable Proteinase Inhibitor with Strong Affinities for Trypsin, Chymotrypsin, Elastase, and Cathepsin G) Z25299 Transcripts which are Detectable by Amplicon as Depicted in Sequence Name Z25299seg20 (SEQ ID NO:996) in Different Normal Tissues Expression of Secretory leukocyte protease inhibitor transcripts detectable by or according to Z25299seg20 (SEQ ID NO:996) amplicon(s) and primers: Z25299seg23F (SEQ ID NO:994) Z25299seg20R (SEQ ID NO:995) was measured by real time PCR. In parallel the expression of four housekeeping genes—RPL19 (GenBank Accession No. NM_000981, (SEQ ID NO:1048); RPL19 amplicon, (SEQ ID NO:1051)), TATA box (GenBank Accession No. NM_003194, (SEQ ID NO:1052); TATA amplicon, (SEQ ID NO:1055)), Ubiquitin (GenBank Accession No. BC000449, (SEQ ID NO: 1056); amplicon—Ubiquitin-amplicon, (SEQ ID NO: 1059)) and SDHA (GenBank Accession No. NM_004168, (SEQ ID NO: 1032); amplicon—SDHA-amplicon, (SEQ ID NO:1035)) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 1 above, Tissue samples in testing panel), to obtain a value of relative expression of each sample relative to median of the ovary samples. Primers and amplicon are as above. Results are shown in FIG. 27B.

Expression of Secretory Leukocyte Protease Inhibitor Z25299 Transcripts, which are Detectable by Amplicon as Depicted in Sequence Name Z25299 seg23 (SEQ ID NO:999) in Normal and Cancerous Ovary Tissues Expression of Secretory leukocyte protease inhibitor Acid-stable proteinase inhibitor transcripts detectable by or according to seg23, Z25299 seg23 (SEQ ID NO:999) amplicon(s) and Z25299 seg23F (SEQ ID NO:997) and Z25299 seg23R (SEQ ID NO:998) primers was measured by real time PCR. In parallel the expression of four housekeeping genes—PBGD (GenBank Accession No. BC019323, (SEQ ID NO: 1036); amplicon—PBGD-amplicon, (SEQ ID NO: 1039)), HPRT1 (GenBank Accession No. NM_000194, (SEQ ID NO: 1040); amplicon—HPRT1-amplicon, (SEQ ID NO:1043)), SDHA (GenBank Accession No. NM_004168, (SEQ ID NO: 1032); amplicon—SDHA-amplicon, (SEQ ID NO: 1035)), and GAPDH (GenBank Accession No. BC026907, (SEQ ID NO:1044); GAPDH amplicon, (SEQ ID NO:1047)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45-48, 71, Table 1, "Tissue samples in testing panel" above), to obtain a value of fold up-regulation for each sample relative to median of the normal PM samples.

Figure 28A:
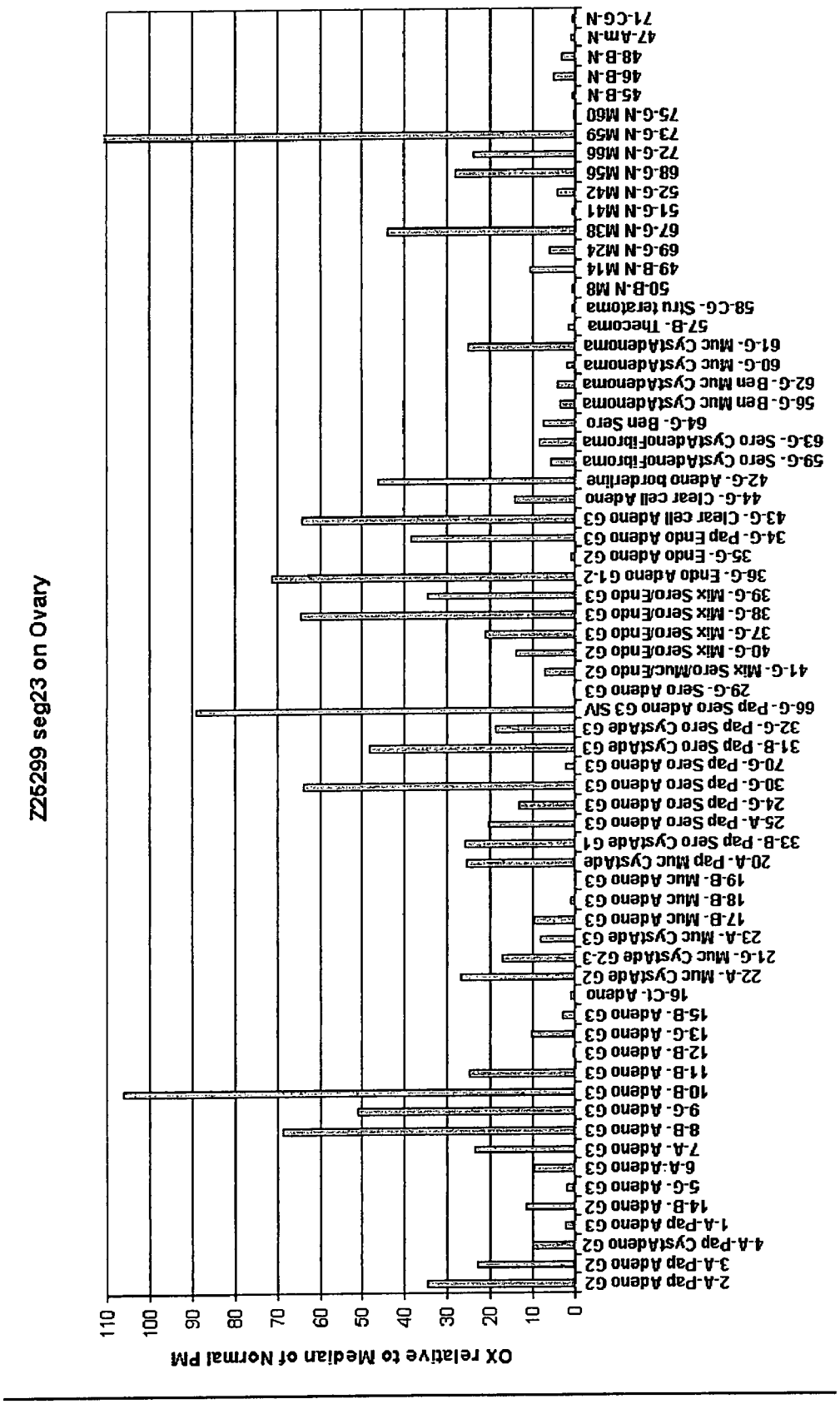
FIGS. 28A and 28B are histograms showing over expression of Z25299 seg23 (SEQ ID NO:999) transcripts in cancerous ovary samples relative to the normal samples (28A) or in normal tissues (28B).

FIG. 28A is a histogram showing over expression of the above-indicated Secretory leukocyte protease inhibitor Acid-stable proteinase inhibitor transcripts in cancerous ovary samples relative to the normal samples.

As is evident from FIG. 28A, the expression of Secretory leukocyte protease inhibitor Acid-stable proteinase inhibitor transcripts detectable by the above amplicon(s) in cancer samples was significantly higher than in the non-cancerous samples (Sample Nos. 45-48, 71, Table 1, "Tissue samples in testing panel"). Notably an over-expression of at least 10 fold was found in 31 out of 43 adenocarcinoma samples.

Statistical analysis was applied to verify the significance of these results, as described below. The P value for the difference in the expression levels of Secretory leukocyte protease inhibitor Acid-stable proteinase inhibitor transcripts detectable by the above amplicon(s) in ovary cancer samples versus the normal tissue samples was determined by T test as 2.48E-07. Threshold of 10 fold overexpression was found to differentiate between cancer and normal samples with P value of 3.61E-03 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: Z25299 seg23F forward primer; and Z25299 seg23R reverse primer.

The present invention also preferably encompasses any amplicon obtained through the use of any suitable primer pair; for example, for the above experiment, the following amplicon was obtained as a non-limiting illustrative example only of a suitable amplicon: Z25299 seg23.

Z25299 seg23 Forward primer (SEQ ID NO:997): CAAG-CAATTGAGGGACCAGG

Z25299 seg23 Reverse primer (SEQ ID NO:998): CAAAAAACATTGTTAATGAGAGAGATGAC

Figure 28B:
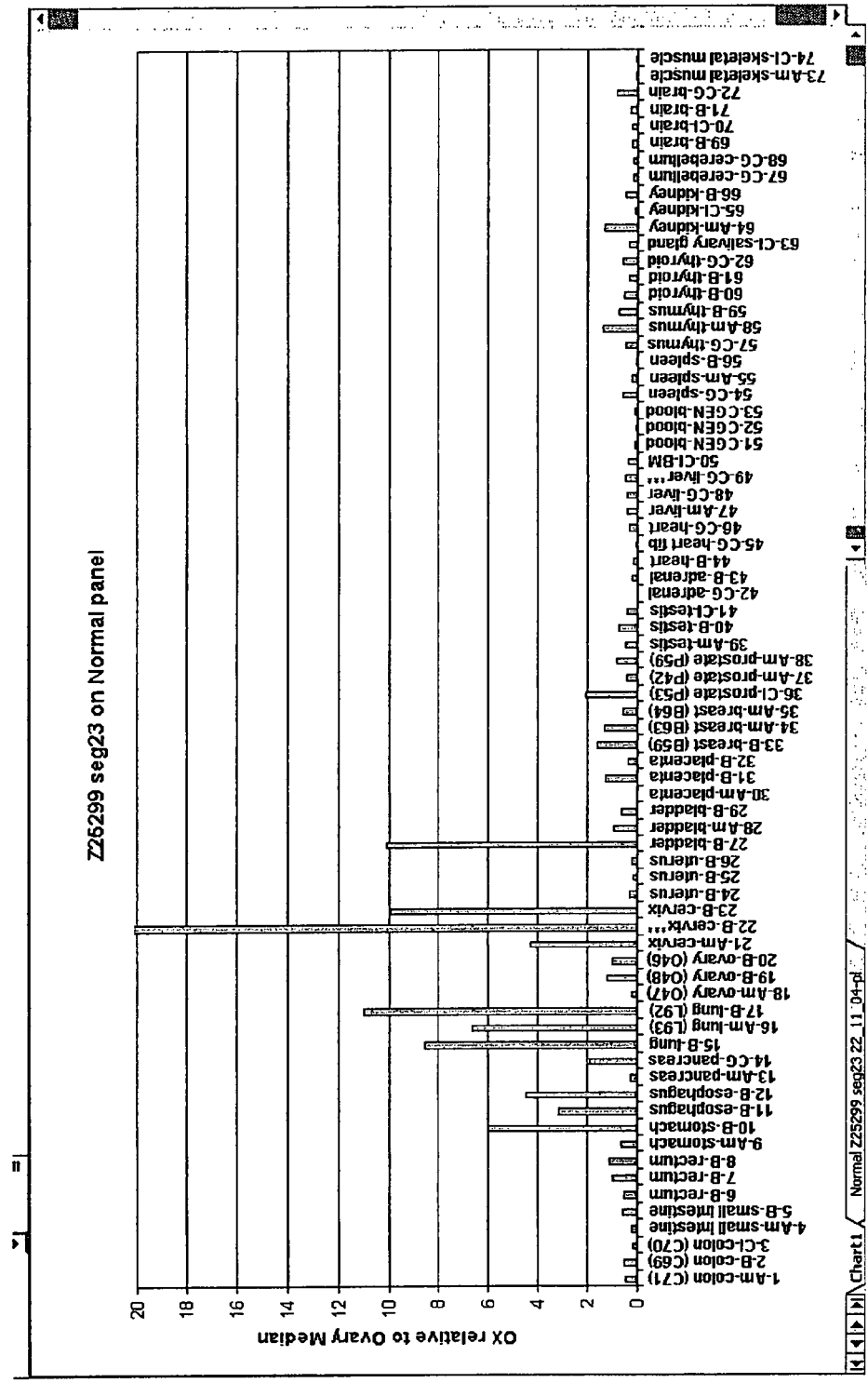

Z25299 seg23 Amplicon (SEQ ID NO:999): CAAG-CAATTGAGGGACCAGGAAGTGGATC-
CTCTAGAGATGAGGAGGCATTCTGCTG GAT-
GACTTTTAAAAATGTTTTCTCCAGAGTCATCTCTCT
CATTAACAATGTTTTTTG Expression of Secretory Leukocyte Protease Inhibitor Z25299 Transcripts which are Detectable by Amplicon as Depicted in Sequence Name Z25299seg23 (SEQ ID NO:999) in Different Normal Tissues Expression of Secretory leukocyte protease inhibitor transcripts detectable by or according to Z25299seg23 (SEQ ID NO:999) amplicon(s) and primers (as above): Z25299seg23F (SEQ ID NO:997) Z25299seg23R (SEQ ID NO:998) was measured by real time PCR. In parallel the expression of four housekeeping genes—RPL19 (GenBank Accession No. NM_000981, (SEQ ID NO:1048); RPL19 amplicon, (SEQ ID NO:1051)), TATA box (GenBank Accession No. NM_003194, (SEQ ID NO:1052); TATA amplicon, (SEQ ID NO:1055)), Ubiquitin (GenBank Accession No. BC000449, (SEQ ID NO: 1056); amplicon—Ubiquitin-amplicon, (SEQ ID NO:1059)) and SDHA (GenBank Accession No. NM_004168, (SEQ ID NO: 1032); amplicon—SDHA-amplicon, (SEQ ID NO: 1035)) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 1 above, Tissue samples in testing panel), to obtain a value of relative expression of each sample relative to median of the ovary samples. Results are shown in FIG. 28B.

DESCRIPTION FOR CLUSTER T39971

Cluster T39971 features 4 transcript(s) and 28 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| T39971_T10 | 570 |
| T39971_T12 | 571 |
| T39971_T16 | 572 |
| T39971_T5 | 573 |

TABLE 2

Segments of interest

| Segment Name | SEQ ID NO: |
|---|---|
| T39971_node_0 | 574 |
| T39971_node_18 | 575 |
| T39971_node_21 | 576 |
| T39971_node_22 | 577 |
| T39971_node_23 | 578 |
| T39971_node_31 | 579 |
| T39971_node_33 | 580 |
| T39971_node_7 | 581 |
| T39971_node_1 | 582 |
| T39971_node_10 | 583 |
| 139971_node_11 | 584 |
| T39971_node_12 | 585 |
| T39971_node_15 | 586 |
| T39971_node_16 | 587 |
| T39971_node_17 | 588 |
| T39971_node_26 | 589 |
| T39971_node_27 | 590 |
| T39971_node_28 | 591 |
| T39971_node_29 | 592 |
| 139971_node_3 | 593 |
| T39971_node_30 | 594 |
| T39971_node_34 | 595 |
| T39971 node 35 | 596 |
| T39971_node 36 | 597 |
| T39971_node_4 | 598 |
| T39971_node_5 | 599 |
| T39971_node_8 | 600 |
| T39971_node_9 | 601 |

TABLE 3

Proteins of interest

| Protein Name | SEQ ID NO: |
|---|---|
| T39971_P6 | 603 |
| T39971_P9 | 604 |
| T39971_P11 | 605 |
| T39971_P12 | 606 |

These sequences are variants of the known protein Vitronectin precursor (SwissProt accession identifier VTNC_HUMAN; known also according to the synonyms Serum spreading factor; S-protein; V75), SEQ ID NO: 602, referred to herein as the previously known protein.

Protein Vitronectin precursor is known or believed to have the following function(s): Vitronectin is a cell adhesion and spreading factor found in serum and tissues. Vitronectin interacts with glycosaminoglycans and proteoglycans. Is recognized by certain members of the integrin family and serves as a cell-to-substrate adhesion molecule. Inhibitor of the membrane-damaging effect of the terminal cytolytic complement pathway. The sequence for protein Vitronectin precursor is given at the end of the application, as "Vitronectin precursor amino acid sequence". Known polymorphisms for this sequence are as shown in Table 4.

TABLE 4

Amino acid mutations for Known Protein

| SNP position(s) on amino acid sequence | Comment |
|---|---|
| 122 | A -> S./FTId = VAR_012983. |
| 268 | R -> Q./FTId = VAR_012984. |
| 400 | T -> M./FTId = VAR_012985. |
| 50 | C -> N |
| 225 | S -> N |
| 366 | A -> T |

Protein Vitronectin precursor localization is believed to be Extracellular.

The previously known protein also has the following indication(s) and/or potential therapeutic use(s): Cancer, melanoma. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Alphavbeta3 integrin antagonist; Apoptosis agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer.

The following GO Annotation(s) apply to the previously known protein. The following annotation(s) were found: immune response; cell adhesion, which are annotation(s) related to Biological Process; protein binding; heparin binding, which are annotation(s) related to Molecular Function; and extracellular space, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster T39971 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 29 refer to weighted expression of ESTs in each category, as "parts per million" (ratio of the expression of ESTs for a particular cluster to the expression of all ESTs in that category, according to parts per million).

Figure 29:
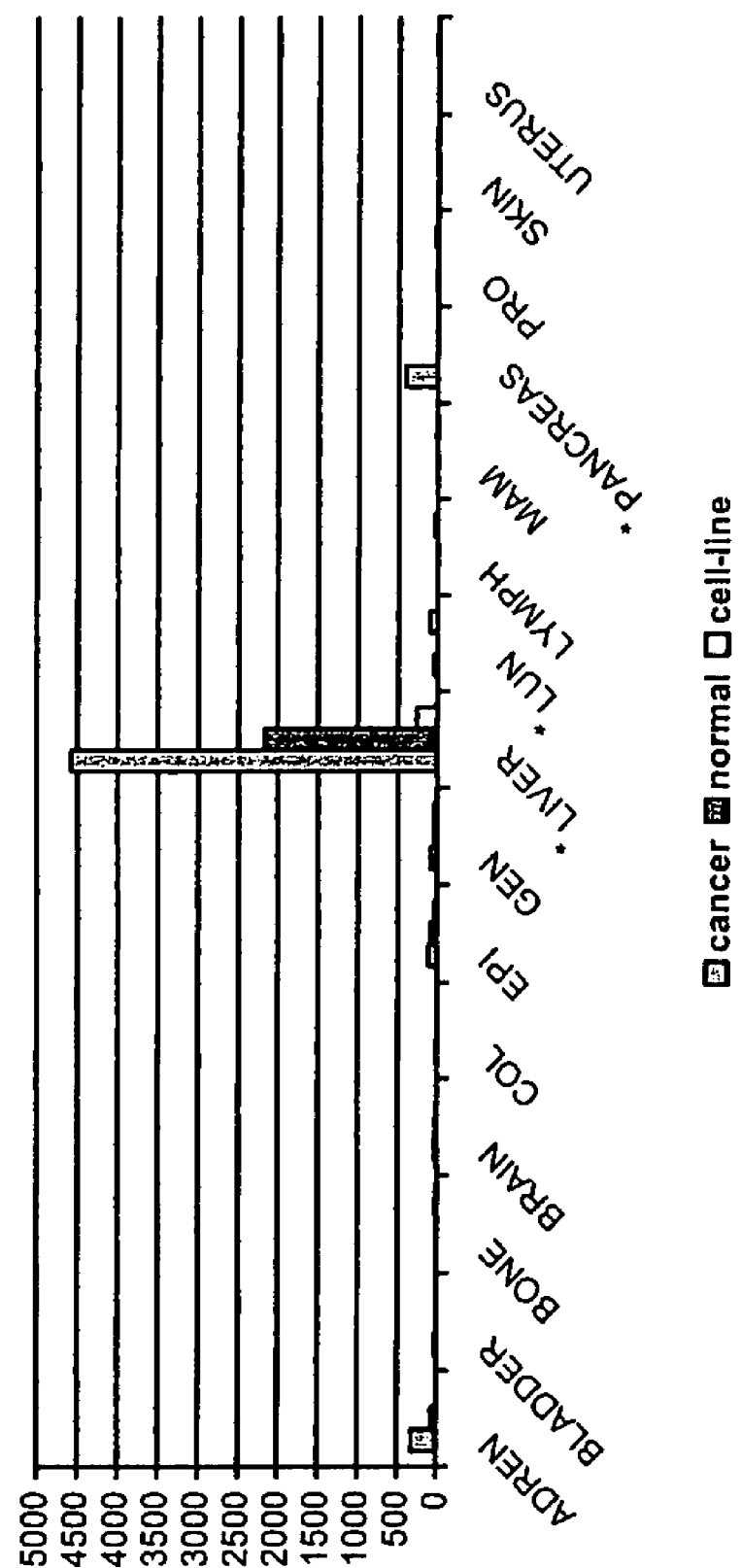
FIG. 29 shows cancer and cell-line vs. normal tissue expression.

Overall, the following results were obtained as shown with regard to the histograms in FIG. 29 and Table 5. This cluster is overexpressed (at least at a minimum level) in the following pathological conditions: liver cancer, lung malignant tumors and pancreas carcinoma.

TABLE 5

Normal tissue distribution

| Name of Tissue | Number |
|---|---|
| adrenal | 60 |
| bladder | 0 |
| bone | 0 |
| brain | 9 |
| colon | 0 |

TABLE 5-continued

Normal tissue distribution

| Name of Tissue | Number |
|---|---|
| epithelial | 79 |
| general | 29 |
| liver | 2164 |
| lung | 0 |
| lymph nodes | 0 |
| breast | 0 |
| pancreas | 0 |
| prostate | 0 |
| skin | 0 |
| uterus | 0 |

TABLE 6

P values and ratios for expression in cancerous tissue

| Name of Tissue | P1 | P2 | SP1 | R3 | SP2 | R4 |
|---|---|---|---|---|---|---|
| adrenal | 6.9e−01 | 7.4e−01 | 2.0e−02 | 2.3 | 5.3e−02 | 1.8 |
| bladder | 5.4e−01 | 6.0e−01 | 5.6e−01 | 1.8 | 6.8e−01 | 1.5 |
| bone | 1 | 6.7e−01 | 1 | 1.0 | 7.0e−01 | 1.4 |
| brain | 8.0e−01 | 8.6e−01 | 3.0e−01 | 1.9 | 5.3e−01 | 1.2 |
| colon | 4.2e−01 | 4.8e−01 | 7.0e−01 | 1.6 | 7.7e−01 | 1.4 |
| epithelial | 6.6e−01 | 5.7e−01 | 1.0e−01 | 0.8 | 8.7e−01 | 0.6 |
| general | 5.1e−01 | 3.8e−01 | 9.2e−08 | 1.6 | 8.3e−04 | 1.3 |
| liver | 1 | 6.7e−01 | 2.3e−03 | 0.3 | 1 | 0.2 |
| lung | 2.4e−01 | 9.1e−02 | 1.7e−01 | 4.3 | 8.1e−03 | 5.0 |
| lymph nodes | 1 | 5.7e−01 | 1 | 1.0 | 5.8e−01 | 2.3 |
| breast | 1 | 6.7e−01 | 1 | 1.0 | 8.2e−01 | 1.2 |
| pancreas | 9.5e−02 | 1.8e−01 | 1.5e−11 | 6.5 | 8.2e−09 | 4.6 |
| prostate | 7.3e−01 | 6.0e−01 | 6.7e−01 | 1.5 | 5.6e−01 | 1.7 |
| skin | 1 | 4.4e−01 | 1 | 1.0 | 6.4e−01 | 1.6 |
| uterus | 5.0e−01 | 2.6e−01 | 1 | 1.1 | 8.0e−01 | 1.4 |

As noted above, cluster T39971 features 4 transcript(s), which were listed in Table 1 above. These transcript(s) encode for protein(s) which are variant(s) of protein Vitronectin precursor. A description of each variant protein according to the present invention is now provided.

Variant protein T39971_P6 (SEQ ID NO: 603) according to the present invention has an amino acid sequence as given at the end of the application; it is encoded by transcript(s) T39971_T5 (SEQ ID NO: 573). An alignment is given to the known protein (Vitronectin precursor) at the end of the application. One or more alignments to one or more previously published protein sequences are given at the end of the application. A brief description of the relationship of the variant protein according to the present invention to each such aligned protein is as follows:

Comparison report between T39971_P6 (SEQ ID NO: 603) and VTNC_HUMAN:

1. An isolated chimeric polypeptide encoding for T39971_P6 (SEQ ID NO: 603), comprising a first amino acid sequence being at least 90% homologous to MAPLRPLLI-LALLAWVALADQESCKGRCTEGFNVD-KKCQCDELCSYYQSCCTDYTAEC KPQVTRGDVFTM-PEDEYTVYDDGEEKNNATVHEQVGGPSLTSDLQAQ SKGNPEQTPV LKPEEEAPAPEVGASKPEGIDSRPETL-HPGRPQPPAEEELCSGKPFDAFTDLKNGSLFAFR GQYCYELDEKAVRPGYPKLIRDVWGIEG-PIDAAFTRINCQGKTYLFKGSQYWRFEDGV LDP-DYPRNISDGFDGIPDNVDAALALPAH-SYSGRERVYFFKG corresponding to amino acids 1-276 of VTNC_HUMAN, which also corresponds to amino acids 1-276 of T39971_P6 (SEQ ID NO: 603), and a second amino acid sequence being at least 70%, optionally at least 80%, preferably at least 85%, more preferably at least 90% and most preferably at least 95% homologous to a polypeptide having the sequence TQGVVGD (SEQ ID NO: 1075) corresponding to amino acids 277-283 of T39971_P6 (SEQ ID NO: 603), wherein said first and second amino acid sequences are contiguous and in a sequential order.

2. An isolated polypeptide encoding for a tail of T39971_P6 (SEQ ID NO: 603), comprising a polypeptide being at least 70%, optionally at least about 80%, preferably at least about 85%, more preferably at least about 90% and most preferably at least about 95% homologous to the sequence TQGVVGD (SEQ ID NO: 1075) in T39971_P6 (SEQ ID NO: 603). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P6 (SEQ ID NO: 603) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein T39971_P6 (SEQ ID NO: 603) sequence provides support for the deduced sequence of this variant protein according to the present invention).

TABLE 7

Amino acid mutations

| SNP position(s) on amino acid sequence | Alternative amino acid(s) | Previously known SNP? |
|---|---|---|
| 122 | A −> S | Yes |
| 145 | G −> | No |
| 268 | R −> Q | Yes |
| 280 | V −> A | Yes |
| 180 | C −> | No |
| 180 | C −> W | No |
| 192 | Y −> | No |
| 209 | A −> | No |
| 211 | T −> | No |
| 267 | G −> | No |
| 267 | G −> A | No |
| 268 | R −> | No |

Variant protein T39971_P6 (SEQ ID NO: 603) is encoded by the following transcript(s): T39971_T5 (SEQ ID NO: 573), for which the sequence(s) is/are given at the end of the application. The coding portion of transcript T39971_T5 (SEQ ID NO: 573) is shown in bold; this coding portion starts at position 756 and ends at position 1604. The transcript also has the following SNPs as listed in Table 8 (given according to their position on the nucleotide sequence, with the alternative nucleic acid listed; the last column indicates whether the SNP is known or not; the presence of known SNPs in variant protein T39971_P6 (SEQ ID NO: 603) sequence provides support for the deduced sequence of this variant protein according to the present invention).

TABLE 8

Nucleic acid SNPs

| SNP position on nucleotide sequence | Alternative nucleic acid | Previously known SNP? |
|---|---|---|
| 417 | G -> C | Yes |
| 459 | T -> C | Yes |
| 1387 | C -> | No |
| 1406 | -> A | No |
| 1406 | -> G | No |
| 1555 | G -> | No |
| 1555 | G -> C | No |
| 1558 | G -> | No |
| 1558 | G -> A | Yes |
| 1594 | T -> C | Yes |
| 1642 | T -> C | Yes |
| 1770 | C -> T | Yes |
| 529 | G -> T | Yes |
| 1982 | A -> G | No |
| 2007 | G -> | No |
| 2029 | T -> C | No |
| 2094 | T -> C | No |
| 2117 | C -> G | No |
| 2123 | C -> T | Yes |
| 2152 | C -> T | Yes |
| 2182 | G -> T | No |
| 2185 | A -> C | No |
| 2297 | T -> C | Yes |
| 1119 | G -> T | Yes |
| 2411 | G -> | No |
| 2411 | G -> T | No |
| 2487 | T -> C | Yes |
| 1188 | G -> | No |
| 1295 | C -> | No |
| 1295 | C -> G | No |
| 1324 | -> T | No |
| 1331 | C -> | No |
| 1381 | C -> | No |

Variant protein T39971_P9 (SEQ ID NO: 604) according to the present invention has an amino acid sequence as given at the end of the application; it is encoded by transcript(s) T39971_T10 (SEQ ID NO: 570). An alignment is given to the known protein (Vitronectin precursor) at the end of the application. One or more alignments to one or more previously published protein sequences are given at the end of the application. A brief description of the relationship of the variant protein according to the present invention to each such aligned protein is as follows:

Comparison report between T39971_P9 (SEQ ID NO: 604) and VTNC_HUMAN:

1. An isolated chimeric polypeptide encoding for T39971_P9 (SEQ ID NO: 604), comprising a first amino acid sequence being at least 90% homologous to MAPLRPLLI-LALLAWVALADQESCKGRCTEGFNVD-KKCQCDELCSYYQSCCTDYTAEC KPQVTRGDVFTM-PEDEYTVYDDGEEKNNATVHEQVGGPSLTSDLQAQS KGNPEQTPV LKPEEEAPAPEVGASKPEGIDSRPETLH-PGRPQPPAEEELCSGKPFDAFTDLKNGSLFAFR GQY-CYELDEKAVRPGYPKLIRDVWGIEGPI-DAAFTRINCQGKTYLFKGSQYWRFEDGV LDPDYPRNISDGFDGIPDNVDAALA-LPAHSYSGRERVYFFKGKQYWEYQFQHPSQEE CEGSSLSAVFEHFAMMQRDSWEDIFELLFWGRT corresponding to amino acids 1-325 of VTNC_HUMAN, which also corresponds to amino acids 1-325 of T39971_P9 (SEQ ID NO: 604), and a second amino acid sequence being at least 90% homologous to SGMAPRPSLAKKQRFRHRN-RKGYRSQRGHSRGRNQNSR-RPSRATWLSLFSSEESNLGA NNYDDYRMDWLVPAT-CEPIQSVFFFSGDKYYRVNLRTRRVDTVDPPYPRSIA QYWLGC PAPGHL corresponding to amino acids 357-478 of VTNC_HUMAN, which also corresponds to amino acids 326-447 of T39971_P9 (SEQ ID NO: 604), wherein said first and second amino acid sequences are contiguous and in a sequential order.

2. An isolated chimeric polypeptide encoding for an edge portion of T39971_P9 (SEQ ID NO: 604), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TS, having a structure as follows: a sequence starting from any of amino acid numbers 325−x to 325; and ending at any of amino acid numbers 326+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P9 (SEQ ID NO: 604) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein T39971_P9 (SEQ ID NO: 604) sequence provides support for the deduced sequence of this variant protein according to the present invention).

TABLE 9

Amino acid mutations

| SNP position(s) on amino acid sequence | Alternative amino acid(s) | Previously known SNP? |
|---|---|---|
| 122 | A -> S | Yes |
| 145 | G -> | No |
| 268 | R -> Q | Yes |
| 328 | M -> T | No |
| 350 | S -> P | No |
| 369 | T -> M | Yes |
| 379 | S -> I | No |
| 380 | N -> T | No |
| 180 | C -> | No |
| 180 | C -> W | No |
| 192 | Y -> | No |
| 209 | A -> | No |
| 211 | T -> | No |
| 267 | G -> | No |
| 267 | G -> A | No |
| 268 | R -> | No |

Variant protein T39971_P9 (SEQ ID NO: 604) is encoded by the following transcript(s): T39971_T10 (SEQ ID NO: 570), for which the sequence(s) is/are given at the end of the application. The coding portion of transcript T39971_T10 (SEQ ID NO: 570) is shown in bold; this coding portion starts at position 756 and ends at position 2096. The transcript also has the following SNPs as listed in Table 10 (given according to their position on the nucleotide sequence, with the alternative nucleic acid listed; the last column indicates whether the SNP is known or not; the presence of known SNPs in variant protein T39971_P9 (SEQ ID NO: 604) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 417 | G -> C | Yes |
| 459 | T -> C | Yes |
| 1387 | C -> | No |
| 1406 | -> A | No |
| 1406 | -> G | No |
| 1555 | G -> | No |
| 1555 | G -> C | No |
| 1558 | G -> | No |
| 1558 | G -> A | Yes |
| 1738 | T -> C | No |
| 1803 | T -> C | No |
| 1826 | C -> G | No |
| 529 | G -> T | Yes |
| 1832 | C -> T | Yes |
| 1861 | C -> T | Yes |
| 1891 | G -> T | No |
| 1894 | A -> C | No |
| 2006 | T -> C | Yes |
| 2120 | G -> | No |
| 2120 | G -> T | No |
| 2196 | T -> C | Yes |
| 1119 | G -> T | Yes |
| 1188 | G -> | No |
| 1295 | C -> | No |
| 1295 | C -> G | No |
| 1324 | -> T | No |
| 1331 | C -> | No |
| 1381 | C -> | No |

Variant protein T39971_P11 (SEQ ID NO: 605) according to the present invention has an amino acid sequence as given at the end of the application; it is encoded by transcript(s) T39971_T12 (SEQ ID NO: 571). An alignment is given to the known protein (Vitronectin precursor) at the end of the application. One or more alignments to one or more previously published protein sequences are given at the end of the application. A brief description of the relationship of the variant protein according to the present invention to each such aligned protein is as follows:

Comparison report between T39971_P11 (SEQ ID NO: 605) and VTNC_HUMAN:

1. An isolated chimeric polypeptide encoding for T39971_P11 (SEQ ID NO: 605), comprising a first amino acid sequence being at least 90% homologous to MAPLR-PLLILALLAWVALADQESCKGRCTEGFN-VDKKCQCDELCSYYQSCCTDYTAEC KPQVTRGD-VFTMPEDEYTVYDDGEEKNNATVHEQVGGPSLTSDL QAQSKGNPEQTPV LKPEEEAPAPEVGASKPEGIDSR-PETLHPGRPQPPAEEELCSGKPFDAFTDLKNGSLFAFR GQYCYELDEKAVRPGYPKLIRDVWGIEG-PIDAAFTRINCQGKTYLFKGSQYWRFEDGV LDP-DYPRNISDGFDGIPDNVDAALALPAH-SYSGRERVYFFKGKQYWEYQFQHQPSQEE CEGSSLSAVFEHFAMMQRDSWEDIFELLFWGRTS corresponding to amino acids 1-326 of VTNC_HUMAN, which also corresponds to amino acids 1-326 of T39971_P11 (SEQ ID NO: 605), and a second amino acid sequence being at least 90% homologous to DKYYRVNLRTRRVDTVDPPYPRSIAQYWLGCPAPGHL corresponding to amino acids 442-478 of VTNC_HUMAN, which also corresponds to amino acids 327-363 of T39971_P11 (SEQ ID NO: 605), wherein said first and second amino acid sequences are contiguous and in a sequential order.

2. An isolated chimeric polypeptide encoding for an edge portion of T39971_P11 (SEQ ID NO: 605), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326–x to 326; and ending at any of amino acid numbers 327+((n−2)−x), in which x varies from 0 to n−2.

Comparison report between T39971_P11 (SEQ ID NO: 605) and Q9BSH7 (SEQ ID NO: 1000) (SEQ ID NO:1000):

1. An isolated chimeric polypeptide encoding for T39971_P11 (SEQ ID NO: 605), comprising a first amino acid sequence being at least 90% homologous to MAPLR-PLLILALLAWVALADQESCKGRCTEGFN-VDKKCQCDELCSYYQSCCTDYTAEC KPQVTRGD-VFTMPEDEYTVYDDGEEKNNATVHEQVGGPSLTSDL QAQSKGNPEQTPV LKPEEEAPAPEVGASKPEGIDSR-PETLHPGRPQPPAEEELCSGKPFDAFTDLKNGSLFAFR GQYCYELDEKAVRPGYPKLIRDVWGIEG-PIDAAFTRINCQGKTYLFKGSQYWRFEDGV LDP-DYPRNISDGFDGIPDNVDAALALPAH-SYSGRERVYFFKGKQYWEYQFQHQPSQEE CEGSSLSAVFEHFAMMQRDSWEDIFELLFWGRTS corresponding to amino acids 1-326 of Q9BSH7 (SEQ ID NO: 1000), which also corresponds to amino acids 1-326 of T39971_P11 (SEQ ID NO: 605), and a second amino acid sequence being at least 90% homologous to DKYYRVNLR-TRRVDTVDPPYPRSIAQYWLGCPAPGHL corresponding to amino acids 442-478 of Q9BSH7 (SEQ ID NO: 1000), which also corresponds to amino acids 327-363 of T39971_P11 (SEQ ID NO: 605), wherein said first and second amino acid sequences are contiguous and in a sequential order.

2. An isolated chimeric polypeptide encoding for an edge portion of T39971_P11 (SEQ ID NO: 605), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326–x to 326; and ending at any of amino acid numbers 327+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P11 (SEQ ID NO: 605) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein T39971_P11 (SEQ ID NO: 605) sequence provides support for the deduced sequence of this variant protein according to the present invention).

TABLE 11

Amino acid mutations

| SNP position(s) on amino acid sequence | Alternative amino acid(s) | Previously known SNP? |
|---|---|---|
| 122 | A -> S | Yes |
| 145 | G -> | No |
| 268 | R -> Q | Yes |
| 180 | C -> | No |
| 180 | C -> W | No |
| 192 | Y -> | No |
| 209 | A -> | No |
| 211 | T -> | No |
| 267 | G -> | No |
| 267 | G -> A | No |
| 268 | R -> | No |

Variant protein T39971_P11 (SEQ ID NO: 605) is encoded by the following transcript(s): T39971_T12 (SEQ ID NO: 571), for which the sequence(s) is/are given at the end of the application. The coding portion of transcript T39971_T12 (SEQ ID NO: 571) is shown in bold; this coding portion starts at position 756 and ends at position 1844. The transcript also has the following SNPs as listed in Table 12 (given according to their position on the nucleotide sequence, with the alternative nucleic acid listed; the last column indicates whether the SNP is known or not; the presence of known SNPs in variant protein T39971_P11 (SEQ ID NO: 605) sequence provides support for the deduced sequence of this variant protein according to the present invention).

TABLE 12

Nucleic acid SNPs

| SNP position on nucleotide sequence | Alternative nucleic acid | Previously known SNP? |
|---|---|---|
| 417 | G -> C | Yes |
| 459 | T -> C | Yes |
| 1387 | C -> | No |
| 1406 | -> A | No |
| 1406 | -> G | No |
| 1555 | G -> | No |
| 1555 | G -> C | No |
| 1558 | G -> | No |
| 1558 | G -> A | Yes |
| 1754 | T -> C | Yes |
| 1868 | G -> | No |
| 1868 | G -> T | No |
| 529 | G -> T | Yes |
| 1944 | T -> C | Yes |
| 1119 | G -> T | Yes |
| 1188 | G -> | No |
| 1295 | C -> | No |
| 1295 | C -> G | No |
| 1324 | -> T | No |
| 1331 | C -> | No |
| 1381 | C -> | No |

Variant protein T39971_P12 (SEQ ID NO: 606) according to the present invention has an amino acid sequence as given at the end of the application; it is encoded by transcript(s) T39971_T16 (SEQ ID NO: 572). An alignment is given to the known protein (Vitronectin precursor) at the end of the application. One or more alignments to one or more previously published protein sequences are given at the end of the application. A brief description of the relationship of the variant protein according to the present invention to each such aligned protein is as follows:

Comparison report between T39971_P12 (SEQ ID NO: 606) and VTNC_HUMAN:

1. An isolated chimeric polypeptide encoding for T39971_P12 (SEQ ID NO: 606), comprising a first amino acid sequence being at least 90% homologous to MAPLRPLLILALLAWVALADQESCKGRCTEGFNVDKKCQCDELCSYYQSCCTDYTAEC KPQVTRGDVFTMPEDEYTVYDDGEEKNNATVHEQVGGPSLTSDLQAQSKGNPEQTPV LKPEEEAPAPEVGASKPEGIDSRPETLHPGRPQPPAEEELCSGKPFDAFTDLKNGSLFAFR GQYCYELDEKAVRPGYPKLIRDVWGIEG-PIDAAFTRINCQGKTYLFK corresponding to amino acids 1-223 of VTNC_HUMAN, which also corresponds to amino acids 1-223 of T39971_P12 (SEQ ID NO: 606), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO: 1076) corresponding to amino acids 224-238 of T39971_P12 (SEQ ID NO: 606), wherein said first and second amino acid sequences are contiguous and in a sequential order.

2. An isolated polypeptide encoding for a tail of T39971_P12 (SEQ ID NO: 606), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO: 1076) in T39971_P12 (SEQ ID NO: 606).

Comparison report between T39971_P12 (SEQ ID NO: 606) and Q9BSH7 (SEQ ID NO: 1000):

1. An isolated chimeric polypeptide encoding for T39971_P12 (SEQ ID NO: 606), comprising a first amino acid sequence being at least 90% homologous to MAPLRPLLILALLAWVALADQESCKGRCTEGFNVDKKCQCDELCSYYQSCCTDYTAEC KPQVTRGDVFTMPEDEYTVYDDGEEKNNATVHEQVGGPSLTSDLQAQSKGNPEQTPV LKPEEEAPAPEVGASKPEGIDSRPETLHPGRPQPPAEEELCSGKPFDAFTDLKNGSLFAFR GQYCYELDEKAVRPGYPKLIRDVWGIEG-PIDAAFTRINCQGKTYLFK corresponding to amino acids 1-223 of Q9BSH7 (SEQ ID NO: 1000), which also corresponds to amino acids 1-223 of T39971_P12 (SEQ ID NO: 606), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO: 1076) corresponding to amino acids 224-238 of T39971_P12 (SEQ ID NO: 606), wherein said first and second amino acid sequences are contiguous and in a sequential order.

2. An isolated polypeptide encoding for a tail of T39971_P12 (SEQ ID NO: 606), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO: 1076) in T39971_P12 (SEQ ID NO: 606).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P12 (SEQ ID NO: 606) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein T39971_P12 (SEQ ID NO: 606) sequence provides support for the deduced sequence of this variant protein according to the present invention).

TABLE 13

Amino acid mutations

| SNP position(s) on amino acid sequence | Alternative amino acid(s) | Previously known SNP? |
|---|---|---|
| 122 | A -> S | Yes |
| 145 | G -> | No |
| 180 | C -> | No |
| 180 | C -> W | No |
| 192 | Y -> | No |
| 209 | A -> | No |
| 211 | T -> | No |

Variant protein T39971_P12 (SEQ ID NO: 606) is encoded by the following transcript(s): T39971_T16 (SEQ ID NO: 572), for which the sequence(s) is/are given at the end of the application. The coding portion of transcript T39971_T16 (SEQ ID NO: 572) is shown in bold; this coding portion starts at position 756 and ends at position 1469. The transcript also has the following SNPs as listed in Table 14 (given according to their position on the nucleotide sequence, with the alternative nucleic acid listed; the last column indicates whether the SNP is known or not; the presence of known SNPs in variant protein T39971_P12 (SEQ ID NO: 606) sequence provides support for the deduced sequence of this variant protein according to the present invention).

TABLE 14

Nucleic acid SNPs

| SNP position on nucleotide sequence | Alternative nucleic acid | Previously known SNP? |
|---|---|---|
| 417 | G -> C | Yes |
| 459 | T -> C | Yes |
| 1387 | C -> | No |
| 1406 | -> A | No |
| 1406 | -> G | No |
| 529 | G -> T | Yes |
| 1119 | G -> T | Yes |
| 1188 | G -> | No |
| 1295 | C -> | No |
| 1295 | C -> G | No |
| 1324 | -> T | No |
| 1331 | C -> | No |
| 1381 | C -> | No |

As noted above, cluster T39971 features 28 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T39971_node_0 (SEQ ID NO: 574) according to the present invention is supported by 76 libraries. The number of libraries was determined as previously described. This segment can be found in the following transcript(s): T39971_T10 (SEQ ID NO: 570), T39971_T12 (SEQ ID NO: 571), T39971_T16 (SEQ ID NO: 572) and T39971_T5 (SEQ ID NO: 573). Table 15 below describes the starting and ending position of this segment on each transcript.

TABLE 15

Segment location on transcripts

| Transcript name | Segment starting position | Segment ending position |
|---|---|---|
| T39971_T10 (SEQ ID NO:570) | 1 | 810 |
| T39971_T12 (SEQ ID NO:571) | 1 | 810 |
| T39971_T16 (SEQ ID NO:572) | 1 | 810 |
| T39971_T5 (SEQ ID NO:573) | 1 | 810 |

Segment cluster T39971_node_18 (SEQ ID NO: 575) according to the present invention is supported by 1 libraries. The number of libraries was determined as previously described. This segment can be found in the following transcript(s): T39971_T16 (SEQ ID NO: 572). Table 16 below describes the starting and ending position of this segment on each transcript.

TABLE 16

Segment location on transcripts

| Transcript name | Segment starting position | Segment ending position |
|---|---|---|
| T39971_T16 (SEQ ID NO:572) | 1425 | 1592 |

Segment cluster T39971_node_21 (SEQ ID NO: 576) according to the present invention is supported by 99 libraries. The number of libraries was determined as previously described. This segment can be found in the following transcript(s): T39971_T10 (SEQ ID NO: 570), T39971_T12 (SEQ ID NO: 571) and T39971_T5 (SEQ ID NO: 573). Table 17 below describes the starting and ending position of this segment on each transcript.

TABLE 17

Segment location on transcripts

| Transcript name | Segment starting position | Segment ending position |
|---|---|---|
| T39971_T10 (SEQ ID NO:570) | 1425 | 1581 |
| T39971_T12 (SEQ ID NO:571) | 1425 | 1581 |
| T39971_T5 (SEQ ID NO:573) | 1425 | 1581 |

Segment cluster T39971_node_22 (SEQ ID NO: 577) according to the present invention is supported by 7 libraries. The number of libraries was determined as previously described. This segment can be found in the following transcript(s): T39971_T5 (SEQ ID NO: 573). Table 18 below describes the starting and ending position of this segment on each transcript.

TABLE 18

Segment location on transcripts

| Transcript name | Segment starting position | Segment ending position |
|---|---|---|
| T39971_T5 (SEQ ID NO:573) | 1582 | 1779 |

Segment cluster T39971_node_23 (SEQ ID NO: 578) according to the present invention is supported by 101 libraries. The number of libraries was determined as previously described. This segment can be found in the following transcript(s): T39971_T10 (SEQ ID NO: 570), T39971_T12 (SEQ ID NO: 571) and T39971_T5 (SEQ ID NO: 573). Table 19 below describes the starting and ending position of this segment on each transcript.

TABLE 19

Segment location on transcripts

| Transcript name | Segment starting position | Segment ending position |
|---|---|---|
| T39971_T10 (SEQ ID NO:570) | 1582 | 1734 |
| T39971_T12 (SEQ ID NO:571) | 1582 | 1734 |
| T39971_T5 (SEQ ID NO:573) | 1780 | 1932 |

Segment cluster T39971_node_31 (SEQ ID NO: 579) according to the present invention is supported by 94 libraries. The number of libraries was determined as previously described. This segment can be found in the following transcript(s): T39971_T10 (SEQ ID NO: 570) and T39971_T5 (SEQ ID NO: 573). Table 20 below describes the starting and ending position of this segment on each transcript.

TABLE 20

Segment location on transcripts

| Transcript name | Segment starting position | Segment ending position |
|---|---|---|
| T39971_T10 (SEQ ID NO:570) | 1847 | 1986 |
| T39971_T5 (SEQ ID NO:573) | 2138 | 2277 |

Segment cluster T39971_node_33 (SEQ ID NO: 580) according to the present invention is supported by 77 libraries. The number of libraries was determined as previously described. This segment can be found in the following transcript(s): T39971_T10 (SEQ ID NO: 570), T39971_T12 (SEQ ID NO: 571) and T39971_T5 (SEQ ID NO: 573). Table 21 below describes the starting and ending position of this segment on each transcript.

TABLE 21

Segment location on transcripts

| Transcript name | Segment starting position | Segment ending position |
|---|---|---|
| T39971_T10 (SEQ ID NO:570) | 1987 | 2113 |
| T39971_T12 (SEQ ID NO:571) | 1735 | 1861 |
| T39971_T5 (SEQ ID NO:573) | 2278 | 2404 |

Segment cluster T39971_node_7 (SEQ ID NO: 581) according to the present invention is supported by 87 libraries. The number of libraries was determined as previously described. This segment can be found in the following transcript(s): T39971_T10 (SEQ ID NO: 570), T39971_T12 (SEQ ID NO: 571), T39971_T16 (SEQ ID NO: 572) and T39971_T5 (SEQ ID NO: 573). Table 22 below describes the starting and ending position of this segment on each transcript.

TABLE 22

Segment location on transcripts

| Transcript name | Segment starting position | Segment ending position |
|---|---|---|
| T39971_T10 (SEQ ID NO:570) | 940 | 1162 |
| T39971_T12 (SEQ ID NO:571) | 940 | 1162 |
| T39971_T16 (SEQ ID NO:572) | 940 | 1162 |
| T39971_T5 (SEQ ID NO:573) | 940 | 1162 |

According to an optional embodiment of the present invention, short segments related to the above cluster are also provided. These segments are up to about 120 bp in length, and so are included in a separate description.

Segment cluster T39971_node_1 (SEQ ID NO: 582) according to the present invention can be found in the following transcript(s): T39971_T10 (SEQ ID NO: 570), T39971_T12 (SEQ ID NO: 571), T39971_T16 (SEQ ID NO: 572) and T39971_T5 (SEQ ID NO: 573). Table 23 below describes the starting and ending position of this segment on each transcript.

TABLE 23

Segment location on transcripts

| Transcript name | Segment starting position | Segment ending position |
|---|---|---|
| T39971_T10 (SEQ ID NO:570) | 811 | 819 |
| T39971_T12 (SEQ ID NO:571) | 811 | 819 |
| T39971_T16 (SEQ ID NO:572) | 811 | 819 |
| T39971_T5 (SEQ ID NO:573) | 811 | 819 |

Segment cluster T39971_node__10 (SEQ ID NO: 583) according to the present invention is supported by 77 libraries. The number of libraries was determined as previously described. This segment can be found in the following transcript(s): T39971_T10 (SEQ ID NO: 570), T39971_T12 (SEQ ID NO: 571), T39971_T16 (SEQ ID NO: 572) and T39971_T5 (SEQ ID NO: 573). Table 24 below describes the starting and ending position of this segment on each transcript.

TABLE 24

Segment location on transcripts

| Transcript name | Segment starting position | Segment ending position |
|---|---|---|
| T39971_T10 (SEQ ID NO:570) | 1189 | 1232 |
| T39971_T12 (SEQ ID NO:571) | 1189 | 1232 |
| T39971_T16 (SEQ ID NO:572) | 1189 | 1232 |
| T39971_T5 (SEQ ID NO:573) | 1189 | 1232 |

Segment cluster T39971_node__11 (SEQ ID NO: 584) according to the present invention is supported by 79 libraries. The number of libraries was determined as previously described. This segment can be found in the following transcript(s): T39971_T10 (SEQ ID NO: 570), T39971_T12 (SEQ ID NO: 571), T39971_T16 (SEQ ID NO: 572) and T39971_T5 (SEQ ID NO: 573). Table 25 below describes the starting and ending position of this segment on each transcript.

TABLE 25

Segment location on transcripts

| Transcript name | Segment starting position | Segment ending position |
|---|---|---|
| T39971_T10 (SEQ ID NO:570) | 1233 | 1270 |
| T39971_T12 (SEQ ID NO:571) | 1233 | 1270 |
| T39971_T16 (SEQ ID NO:572) | 1233 | 1270 |
| T39971_T5 (SEQ ID NO:573) | 1233 | 1270 |

Segment cluster T39971_node__12 (SEQ ID NO: 585) according to the present invention can be found in the following transcript(s): T39971_T10 (SEQ ID NO: 570), T39971_T12 (SEQ ID NO: 571), T39971_T16 (SEQ ID NO: 572) and T39971_T5 (SEQ ID NO: 573). Table 26 below describes the starting and ending position of this segment on each transcript.

TABLE 26

Segment location on transcripts

| Transcript name | Segment starting position | Segment ending position |
|---|---|---|
| T39971_T10 (SEQ ID NO:570) | 1271 | 1284 |
| T39971_T12 (SEQ ID NO:571) | 1271 | 1284 |
| T39971_T16 (SEQ ID NO:572) | 1271 | 1284 |
| T39971_T5 (SEQ ID NO:573) | 1271 | 1284 |

Segment cluster T39971_node__15 (SEQ ID NO: 586) according to the present invention is supported by 79 libraries. The number of libraries was determined as previously described. This segment can be found in the following transcript(s): T39971_T10 (SEQ ID NO: 570), T39971_T12 (SEQ ID NO: 571), T39971_T16 (SEQ ID NO: 572) and T39971_T5 (SEQ ID NO: 573). Table 27 below describes the starting and ending position of this segment on each transcript.

TABLE 27

Segment location on transcripts

| Transcript name | Segment starting position | Segment ending position |
|---|---|---|
| T39971_T10 (SEQ ID NO:570) | 1285 | 1316 |
| T39971_T12 (SEQ ID NO:571) | 1285 | 1316 |
| T39971_T16 (SEQ ID NO:572) | 1285 | 1316 |
| T39971_T5 (SEQ ID NO:573) | 1285 | 1316 |

Segment cluster T39971_node__16 (SEQ ID NO: 587) according to the present invention can be found in the following transcript(s): T39971_T10 (SEQ ID NO: 570), T39971_T12 (SEQ ID NO: 571), T39971_T16 (SEQ ID NO: 572) and T39971_T5 (SEQ ID NO: 573). Table 28 below describes the starting and ending position of this segment on each transcript.

TABLE 28

Segment location on transcripts

| Transcript name | Segment starting position | Segment ending position |
|---|---|---|
| T39971_T10 (SEQ ID NO:570) | 1317 | 1340 |
| T39971_T12 (SEQ ID NO:571) | 1317 | 1340 |
| T39971_T16 (SEQ ID NO:572) | 1317 | 1340 |
| T39971_T5 (SEQ ID NO:573) | 1317 | 1340 |

Segment cluster T39971_node__17 (SEQ ID NO: 588) according to the present invention is supported by 86 libraries. The number of libraries was determined as previously described. This segment can be found in the following transcript(s): T39971_T10 (SEQ ID NO: 570), T39971_T12 (SEQ ID NO: 571), T39971_T16 (SEQ ID NO: 572) and T39971_T5 (SEQ ID NO: 573). Table 29 below describes the starting and ending position of this segment on each transcript.

TABLE 29

Segment location on transcripts

| Transcript name | Segment starting position | Segment ending position |
|---|---|---|
| T39971_T10 (SEQ ID NO:570) | 1341 | 1424 |
| T39971_T12 (SEQ ID NO:571) | 1341 | 1424 |
| T39971_T16 (SEQ ID NO:572) | 1341 | 1424 |
| T39971_T5 (SEQ ID NO:573) | 1341 | 1424 |

Segment cluster T39971_node__26 (SEQ ID NO: 589) according to the present invention is supported by 85 libraries. The number of libraries was determined as previously described. This segment can be found in the following transcript(s): T39971_T5 (SEQ ID NO: 573). Table 30 below describes the starting and ending position of this segment on each transcript.

TABLE 30

Segment location on transcripts

| Transcript name | Segment starting position | Segment ending position |
|---|---|---|
| T39971_T5 (SEQ ID NO:573) | 1933 | 1974 |

Segment cluster T39971_node__27 (SEQ ID NO: 590) according to the present invention is supported by 90 libraries. The number of libraries was determined as previously described. This segment can be found in the following transcript(s): T39971_T5 (SEQ ID NO: 573). Table 31 below describes the starting and ending position of this segment on each transcript.

TABLE 31

Segment location on transcripts

| Transcript name | Segment starting position | Segment ending position |
|---|---|---|
| T39971_T5 (SEQ ID NO:573) | 1975 | 2025 |

Segment cluster T39971_node__28 (SEQ ID NO: 591) according to the present invention can be found in the following transcript(s): T39971_T10 (SEQ ID NO: 570) and T39971_T5 (SEQ ID NO: 573). Table 32 below describes the starting and ending position of this segment on each transcript.

TABLE 32

Segment location on transcripts

| Transcript name | Segment starting position | Segment ending position |
|---|---|---|
| T39971_T10 (SEQ ID NO:570) | 1735 | 1743 |
| T39971_T5 (SEQ ID NO:573) | 2026 | 2034 |

Segment cluster T39971_node__29 (SEQ ID NO: 592) according to the present invention is supported by 99 libraries. The number of libraries was determined as previously described. This segment can be found in the following transcript(s): T39971_T10 (SEQ ID NO: 570) and T39971_T5 (SEQ ID NO: 573). Table 33 below describes the starting and ending position of this segment on each transcript.

TABLE 33

Segment location on transcripts

| Transcript name | Segment starting position | Segment ending position |
|---|---|---|
| T39971_T10 (SEQ ID NO:570) | 1744 | 1838 |
| T39971_T5 (SEQ ID NO:573) | 2035 | 2129 |

Segment cluster T39971_node__3 (SEQ ID NO: 593) according to the present invention is supported by 78 libraries. The number of libraries was determined as previously described. This segment can be found in the following transcript(s): T39971_T10 (SEQ ID NO: 570), T39971_T12 (SEQ ID NO: 571), T39971_T16 (SEQ ID NO: 572) and T39971_T5 (SEQ ID NO: 573). Table 34 below describes the starting and ending position of this segment on each transcript.

TABLE 34

Segment location on transcripts

| Transcript name | Segment starting position | Segment ending position |
|---|---|---|
| T39971_T10 (SEQ ID NO:570) | 820 | 861 |
| T39971_T12 (SEQ ID NO:571) | 820 | 861 |
| T39971_T16 (SEQ ID NO:572) | 820 | 861 |
| T39971_T5 (SEQ ID NO:573) | 820 | 861 |

Segment cluster T39971_node__30 (SEQ ID NO: 594) according to the present invention can be found in the following transcript(s): T39971_T10 (SEQ ID NO: 570) and T39971_T5 (SEQ ID NO: 573). Table 35 below describes the starting and ending position of this segment on each transcript.

TABLE 35

Segment location on transcripts

| Transcript name | Segment starting position | Segment ending position |
|---|---|---|
| T39971_T10 (SEQ ID NO:570) | 1839 | 1846 |
| T39971_T5 (SEQ ID NO:573) | 2130 | 2137 |

Segment cluster T39971_node__34 (SEQ ID NO: 595) according to the present invention can be found in the following transcript(s): T39971_T10 (SEQ ID NO: 570), T39971_T12 (SEQ ID NO: 571) and T39971_T5 (SEQ ID NO: 573). Table 36 below describes the starting and ending position of this segment on each transcript.

TABLE 36

Segment location on transcripts

| Transcript name | Segment starting position | Segment ending position |
|---|---|---|
| T39971_T10 (SEQ ID NO:570) | 2114 | 2120 |
| T39971_T12 (SEQ ID NO:571) | 1862 | 1868 |
| T39971_T5 (SEQ ID NO:573) | 2405 | 2411 |

Segment cluster T39971_node_35 (SEQ ID NO: 596) according to the present invention can be found in the following transcript(s): T39971_T10 (SEQ ID NO: 570), T39971_T12 (SEQ ID NO: 571) and T39971_T5 (SEQ ID NO: 573). Table 37 below describes the starting and ending position of this segment on each transcript.

TABLE 37

Segment location on transcripts

| Transcript name | Segment starting position | Segment ending position |
|---|---|---|
| T39971_T10 (SEQ ID NO:570) | 2121 | 2137 |
| T39971_T12 (SEQ ID NO:571) | 1869 | 1885 |
| T39971_T5 (SEQ ID NO:573) | 2412 | 2428 |

Segment cluster T39971_node_36 (SEQ ID NO: 597) according to the present invention is supported by 51 libraries. The number of libraries was determined as previously described. This segment can be found in the following transcript(s): T39971_T10 (SEQ ID NO: 570), T39971_T12 (SEQ ID NO: 571) and T39971_T5 (SEQ ID NO: 573). Table 38 below describes the starting and ending position of this segment on each transcript.

TABLE 38

Segment location on transcripts

| Transcript name | Segment starting position | Segment ending position |
|---|---|---|
| T39971_T10 (SEQ ID NO:570) | 2138 | 2199 |
| T39971_T12 (SEQ ID NO:571) | 1886 | 1947 |
| T39971_T5 (SEQ ID NO:573) | 2429 | 2490 |

Segment cluster T39971_node_4 (SEQ ID NO: 598) according to the present invention can be found in the following transcript(s): T39971_T10 (SEQ ID NO: 570), T39971_T12 (SEQ ID NO: 571), T39971_T16 (SEQ ID NO: 572) and T39971_T5 (SEQ ID NO: 573). Table 39 below describes the starting and ending position of this segment on each transcript.

TABLE 39

Segment location on transcripts

| Transcript name | Segment starting position | Segment ending position |
|---|---|---|
| T39971_T10 (SEQ ID NO:570) | 862 | 881 |
| T39971_T12 (SEQ ID NO:571) | 862 | 881 |
| T39971_T16 (SEQ ID NO:572) | 862 | 881 |
| T39971_T5 (SEQ ID NO:573) | 862 | 881 |

Segment cluster T39971_node_5 (SEQ ID NO: 595) according to the present invention is supported by 80 libraries. The number of libraries was determined as previously described. This segment can be found in the following transcript(s): T39971_T10 (SEQ ID NO: 570), T39971_T12 (SEQ ID NO: 571), T39971_T16 (SEQ ID NO: 572) and T39971_T5 (SEQ ID NO: 573). Table 40 below describes the starting and ending position of this segment on each transcript.

TABLE 40

Segment location on transcripts

| Transcript name | Segment starting position | Segment ending position |
|---|---|---|
| T39971_T10 (SEQ ID NO:570) | 882 | 939 |
| T39971_T12 (SEQ ID NO:571) | 882 | 939 |
| T39971_T16 (SEQ ID NO:572) | 882 | 939 |
| T39971_T5 (SEQ ID NO:573) | 882 | 939 |

Segment cluster T39971_node_8 (SEQ ID NO: 600) according to the present invention can be found in the following transcript(s): T39971_T10 (SEQ ID NO: 570), T39971_T12 (SEQ ID NO: 571), T39971_T16 (SEQ ID NO: 572) and T39971_T5 (SEQ ID NO: 573). Table 41 below describes the starting and ending position of this segment on each transcript.

TABLE 41

Segment location on transcripts

| Transcript name | Segment starting position | Segment ending position |
|---|---|---|
| T39971_T10 (SEQ ID NO:570) | 1163 | 1168 |
| T39971_T12 (SEQ ID NO:571) | 1163 | 1168 |
| T39971_T16 (SEQ ID NO:572) | 1163 | 1168 |
| T39971_T5 (SEQ ID NO:573) | 1163 | 1168 |

Segment cluster T39971_node_9 (SEQ ID NO: 601) according to the present invention can be found in the following transcript(s): T39971_T10 (SEQ ID NO: 570), T39971_T12 (SEQ ID NO: 571), T39971_T16 (SEQ ID NO: 572) and T39971_T5 (SEQ ID NO: 573). Table 42 below describes the starting and ending position of this segment on each transcript.

TABLE 42

Segment location on transcripts

| Transcript name | Segment starting position | Segment ending position |
|---|---|---|
| T39971_T10 (SEQ ID NO:570) | 1169 | 1188 |
| T39971_T12 (SEQ ID NO:571) | 1169 | 1188 |
| T39971_T16 (SEQ ID NO:572) | 1169 | 1188 |
| T39971_T5 (SEQ ID NO:573) | 1169 | 1188 |

Variant protein alignment to the previously known protein:

Sequence name: /tmp/xkraCL2OcZ/43L7YcPH7x:VTNC_HUMAN

Sequence documentation:

Alignment of: T39971_P6 (SEQ ID NO: 603) x VTNC_HUMAN . . .

Alignment segment 1/1:
  Quality: 2774.00

Escore: 0
  Matching length: 278 Total length: 278

Matching Percent Similarity: 99.64 Matching Percent

Identity: 99.64
  Total Percent Similarity: 99.64 Total Percent

Identity: 99.64
  Gaps: 0

Alignment:

Sequence name: /tmp/X4DeeuSlB4/yMubSR5FPs:VTNC_HUMAN

Sequence documentation:

Alignment of: T39971_P9 (SEQ ID NO: 604) x VTNC_HUMAN . . .

Alignment segment 1/1:
  Quality: 4430.00

Escore: 0

Matching length: 447 Total length: 478

Matching Percent Similarity: 100.00 Matching Percent

Identity: 100.00

Total Percent Similarity: 93.51 Total Percent

Identity: 93.51
  Gaps: 1

```
  1 MAPLRPLLILALLAWVALADQESCKGRCTEGFNVDKKCQCDELCSYYQSC    50
    ||||||||||||||||||||||||||||||||||||||||||||||||||
  1 MAPLRPLLILALLAWVALADQESCKGRCTEGFNVDKKCQCDELCSYYQSC    50

51 CTDYTAECKPQVTRGDVFTMPEDEYTVYDDGEEKNNATVHEQVGGPSLTS   100
    ||||||||||||||||||||||||||||||||||||||||||||||||||
 51 CTDYTAECKPQVTRGDVFTMPEDEYTVYDDGEEKNNATVHEQVGGPSLTS   100

101 DLQAQSKGNPEQTPVLKPEEEAPAPEVGASKPEGIDSRPETLHPGRPQPP   150
    ||||||||||||||||||||||||||||||||||||||||||||||||||
101 DLQAQSKGNPEQTPVLKPEEEAPAPEVGASKPEGIDSRPETLHPGRPQPP   150

151 AEEELCSGKPFDAFTDLKNGSLFAFRGQYCYELDEKAVRPGYPKLIRDVW   200
    ||||||||||||||||||||||||||||||||||||||||||||||||||
151 AEEELCSGKPFDAFTDLKNGSLFAFRGQYCYELDEKAVRPGYPKLIRDVW   200

201 GIEGPIDAAFTRINCQGKTYLFKGSQYWRFEDGVLDPDYPRNISDGFDGI   250
    ||||||||||||||||||||||||||||||||||||||||||||||||||
201 GIEGPIDAAFTRINCQGKTYLFKGSQYWRFEDGVLDPDYPRNISDGFDGI   250

251 PDNVDAALALPAHSYSGRERVYFFKGTQ                         278
    ||||||||||||||||||||||||||||
251 PDNVDAALALPAHSYSGRERVYFFKGTQ                         278
```

Alignment:

```
  1 MAPLRPLLILALLAWVALADQESCKGRCTEGFNVDKKCQCDELCSYYQSC   50
    ||||||||||||||||||||||||||||||||||||||||||||||||||
  1 MAPLRPLLILALLAWVALADQESCKGRCTEGFNVDKKCQCDELCSYYQSC   50

51 CTDYTAECKPQVTRGDVFTMPEDEYTVYDDGEEKNNATVHEQVGGPSLTS  100
    ||||||||||||||||||||||||||||||||||||||||||||||||||
 51 CTDYTAECKPQVTRGDVFTMPEDEYTVYDDGEEKNNATVHEQVGGPSLTS  100

101 DLQAQSKGNPEQTPVLKPEEEAPAPEVGASKPEGIDSRPETLHPGRPQPP  150
    ||||||||||||||||||||||||||||||||||||||||||||||||||
101 DLQAQSKGNPEQTPVLKPEEEAPAPEVGASKPEGIDSRPETLHPGRPQPP  150

151 AEEELCSGKPFDAFTDLKNGSLFAFRGQYCYELDEKAVRPGYPKLIRDVW  200
    ||||||||||||||||||||||||||||||||||||||||||||||||||
151 AEEELCSGKPFDAFTDLKNGSLFAFRGQYCYELDEKAVRPGYPKLIRDVW  200

201 GIEGPIDAAFTRINCQGKTYLFKGSQYWRFEDGVLDPDYPRNISDGFDGI  250
    ||||||||||||||||||||||||||||||||||||||||||||||||||
201 GIEGPIDAAFTRINCQGKTYLFKGSQYWRFEDGVLDPDYPRNISDGFDGI  250

251 PDNVDAALALPAHSYSGRERVYFFKGKQYWEYQFQHQPSQEECEGSSLSA  300
    ||||||||||||||||||||||||||||||||||||||||||||||||||
251 PDNVDAALALPAHSYSGRERVYFFKGKQYWEYQFQHQPSQEECEGSSLSA  300

301 VFEHFAMMQRDSWEDIFELLFWGRT.........................  325
    ||||||||||||||||||||||||
301 VFEHFAMMQRDSWEDIFELLFWGRTSAGTRQPQFISRDWHGVPGQVDAAM  350

326 ......SGMAPRPSLAKKQRFRHRNKGYRSQRGHSRGRNQNSRRPSRAT   369
          ||||||||||||||||||||||||||||||||||||||||||||
351 AGRIYISGMAPRPSLAKKQRFRHRNKGYRSQRGHSRGRNQNSRRPSRAT   400

370 WLSLFSSEESNLGANNYDDYRMDWLVPATCEPIQSVFFFSGDKYYRVNLR  419
    ||||||||||||||||||||||||||||||||||||||||||||||||||
401 WLSLFSSEESNLGANNYDDYRMDWLVPATCEPIQSVFFFSGDKYYRVNLR  450

420 TRRVDTVDPPYPRSIAQYWLGCPAPGHL                        447
    ||||||||||||||||||||||||||||
451 TRRVDTVDPPYPRSIAQYWLGCPAPGHL                        478
```

Sequence name: /tmp/jvp1VtnxNy/wxNSeFVZZw:VT-NC_HUMAN

Sequence documentation:

Alignment of: T39971_P11 (SEQ ID NO: 605) x VTNC_HUMAN ...

Alignment segment 1/1:
 Quality: 3576.00

Escore: 0
 Matching length: 363 Total length: 478

Matching Percent Similarity: 100.00 Matching Percent
Identity: 100.00
 Total Percent Similarity: 75.94 Total Percent
Identity: 75.94
 Gaps: 1

Alignment:

```
  1 MAPLRPLLILALLAWVALADQESCKGRCTEGFNVDKKCQCDELCSYYQSC   50
    ||||||||||||||||||||||||||||||||||||||||||||||||||
  1 MAPLRPLLILALLAWVALADQESCKGRCTEGFNVDKKCQCDELCSYYQSC   50

51 CTDYTAECKPQVTRGDVFTMPEDEYTVYDDGEEKNNATVHEQVGGPSLTS  100
    ||||||||||||||||||||||||||||||||||||||||||||||||||
 51 CTDYTAECKPQVTRGDVFTMPEDEYTVYDDGEEKNNATVHEQVGGPSLTS  100

101 DLQAQSKGNPEQTPVLKPEEEAPAPEVGASKPEGIDSRPETLHPGRPQPP  150
    ||||||||||||||||||||||||||||||||||||||||||||||||||
101 DLQAQSKGNPEQTPVLKPEEEAPAPEVGASKPEGIDSRPETLHPGRPQPP  150

151 AEEELCSGKPFDAFTDLKNGSLFAFRGQYCYELDEKAVRPGYPKLIRDVW  200
    ||||||||||||||||||||||||||||||||||||||||||||||||||
151 AEEELCSGKPFDAFTDLKNGSLFAFRGQYCYELDEKAVRPGYPKLIRDVW  200
```

-continued

```
201 GIEGPIDAAFTRINCQGKTYLFKGSQYWRFEDGVLDPDYPRNISDGFDGI 250
    |||||||||||||||||||||||||||||||||||||||||||||||||
201 GIEGPIDAAFTRINCQGKTYLFKGSQYWRFEDGVLDPDYPRNISDGFDGI 250

251 PDNVDAALALPAHSYSGRERVYFFKGKQYWEYQFQHQPSQEECEGSSLSA 300
    |||||||||||||||||||||||||||||||||||||||||||||||||
251 PDNVDAALALPAHSYSGRERVYFFKGKQYWEYQFQHQPSQEECEGSSLSA 300

301 VFEHFAMMQRDSWEDIFELLFWGRTS........................ 326
    |||||||||||||||||||||||||
301 VFEHFAMMQRDSWEDIFELLFWGRTSAGTRQPQFISRDWHGVPGQVDAAM 350

326 .................................................. 326

351 AGRIYISGMAPRPSLAKKQRFRHRNRKGYRSQRGHSRGRNQNSRRPSRAT 400

327 ................................DKYYRVNLR 335
                                    |||||||||
401 WLSLFSSEESNLGANNYDDYRMDWLVPATCEPIQSVFFFSGDKYYRVNLR 450

336 TRRVDTVDPPYPRSIAQYWLGCPAPGHL 363
    ||||||||||||||||||||||||||||
451 TRRVDTVDPPYPRSIAQYWLGCPAPGHL 478
```

Sequence name: /tmp/jvp1VtnxNy/wxNSeFVZZw: Q9BSH7 (SEQ ID NO: 1000)

Sequence documentation:

Alignment of: T39971_P11 (SEQ ID NO: 605) x Q9BSH7 (SEQ ID NO: 1000) . . .

Alignment segment 1/1:
  Quality: 3576.00

Escore: 0
  Matching length: 363 Total length: 478

Matching Percent Similarity: 100.00 Matching Percent Identity: 100.00

Total Percent Similarity: 75.94 Total Percent Identity: 75.94

Gaps: 1

Alignment:

```
  1 MAPLRPLLILALLAWVALADQESCKGRCTEGFNVDKKCQCDELCSYYQSC 50
    |||||||||||||||||||||||||||||||||||||||||||||||||
  1 MAPLRPLLILALLAWVALADQESCKGRCTEGFNVDKKCQCDELCSYYQSC 50

51 CTDYTAECKPQVTRGDVFTMPEDEYTVYDDGEEKNNATVHEQVGGPSLTS 100
    |||||||||||||||||||||||||||||||||||||||||||||||||
 51 CTDYTAECKPQVTRGDVFTMPEDEYTVYDDGEEKNNATVHEQVGGPSLTS 100

101 DLQAQSKGNPEQTPVLKPEEEAPAPEVGASKPEGIDSRPETLHPGRPQPP 150
    |||||||||||||||||||||||||||||||||||||||||||||||||
101 DLQAQSKGNPEQTPVLKPEEEAPAPEVGASKPEGIDSRPETLHPGRPQPP 150

151 AEEELCSGKPFDAFTDLKNGSLFAFRGQYCYELDEKAVRPGYPKLIRDVW 200
    |||||||||||||||||||||||||||||||||||||||||||||||||
151 AEEELCSGKPFDAFTDLKNGSLFAFRGQYCYELDEKAVRPGYPKLIRDVW 200

201 GIEGPIDAAFTRINCQGKTYLFKGSQYWRFEDGVLDPDYPRNISDGFDGI 250
    |||||||||||||||||||||||||||||||||||||||||||||||||
201 GIEGPIDAAFTRINCQGKTYLFKGSQYWRFEDGVLDPDYPRNISDGFDGI 250

251 PDNVDAALALPAHSYSGRERVYFFKGKQYWEYQFQHQPSQEECEGSSLSA 300
    |||||||||||||||||||||||||||||||||||||||||||||||||
251 PDNVDAALALPAHSYSGRERVYFFKGKQYWEYQFQHQPSQEECEGSSLSA 300

301 VFEHFAMMQRDSWEDIFELLFWGRTS........................ 326
    |||||||||||||||||||||||||
301 VFEHFAMMQRDSWEDIFELLFWGRTSAGTRQPQFISRDWHGVPGQVDAAM 350

326 .................................................. 326

351 AGRIYISGMAPRPSLAKKQRFRHRNRKGYRSQRGHSRGRNQNSRRPSRAM 400

327 ................................DKYYRVNLR 335
                                    |||||||||
401 WLSLFSSEESNLGANNYDDYRMDWLVPATCEPIQSVFFFSGDKYYRVNLR 450
```

-continued

```
336  TRRVDTVDPPYPRSIAQYWLGCPAPGHL  363
     |||||||||||||||||||||||||||
451  TRRVDTVDPPYPRSIAQYWLGCPAPGHL  478
```

Sequence name: /tmp/fgebv7ir41/48bTBMziJ0:VTNC_HUMAN

Sequence documentation:

Alignment of: T39971_P12 (SEQ ID NO: 606) x VTNC_HUMAN . . .

Alignment segment 1/1:
 Quality: 2237.00

Escore: 0
 Matching length: 223 Total length: 223

Matching Percent Similarity: 100.00 Matching Percent Identity: 100.00
 Total Percent Similarity: 100.00 Total Percent Identity: 100.00
 Gaps: 0

Alignment:

Sequence documentation:

Alignment of: T39971_P12 (SEQ ID NO: 606) x Q9BSH7 (SEQ ID NO: 1000) . . .

Alignment segment 1/1:
 Quality: 2237.00

Escore: 0
 Matching length: 223 Total length: 223

Matching Percent Similarity: 100.00 Matching Percent Identity: 100.00
 Total Percent Similarity: 100.00 Total Percent Identity: 100.00
 Gaps: 0

```
  1  MAPLRPLLILALLAWVALADQESCKGRCTEGFNVDKKCQCDELCSYYQSC   50
     ||||||||||||||||||||||||||||||||||||||||||||||||||
  1  MAPLRPLLILALLAWVALADQESCKGRCTEGFNVDKKCQCDELCSYYQSC   50

51  CTDYTAECKPQVTRGDVFTMPEDEYTVYDDGEEKNNATVHEQVGGPSLTS  100
     ||||||||||||||||||||||||||||||||||||||||||||||||||
 51  CTDYTAECKPQVTRGDVFTMPEDEYTVYDDGEEKNNATVHEQVGGPSLTS  100

101  DLQAQSKGNPEQTPVLKPEEEAPAPEVGASKPEGIDSRPETLHPGRPQPP  150
     ||||||||||||||||||||||||||||||||||||||||||||||||||
101  DLQAQSKGNPEQTPVLKPEEEAPAPEVGASKPEGIDSRPETLHPGRPQPP  150

151  AEEELCSGKPFDAFTDLKNGSLFAFRGQYCYELDEKAVRPGYPKLIRDVW  200
     ||||||||||||||||||||||||||||||||||||||||||||||||||
151  AEEELCSGKPFDAFTDLKNGSLFAFRGQYCYELDEKAVRPGYPKLIRDVW  200

201  GIEGPIDAAFTRINCQGKTYLFK                            223
     |||||||||||||||||||||||
201  GIEGPIDAAFTRINCQGKTYLFK                            223
```

Sequence name: /tmp/fgebv7ir41/48bTBMziJ0:Q9BSH7 (SEQ ID NO: 1000)

Alignment:

```
  1  MAPLRPLLILALLAWVALADQESCKGRCTEGFNVDKKCQCDELCSYYQSC   50
     ||||||||||||||||||||||||||||||||||||||||||||||||||
  1  MAPLRPLLILALLAWVALADQESCKGRCTEGFNVDKKCQCDELCSYYQSC   50

51  CTDYTAECKPQVTRGDVFTMPEDEYTVYDDGEEKNNATVHEQVGGPSLTS  100
     ||||||||||||||||||||||||||||||||||||||||||||||||||
 51  CTDYTAECKPQVTRGDVFTMPEDEYTVYDDGEEKNNATVHEQVGGPSLTS  100

101  DLQAQSKGNPEQTPVLKPEEEAPAPEVGASKPEGIDSRPETLHPGRPQPP  150
     ||||||||||||||||||||||||||||||||||||||||||||||||||
101  DLQAQSKGNPEQTPVLKPEEEAPAPEVGASKPEGIDSRPETLHPGRPQPP  150

151  AEEELCSGKPFDAFTDLKNGSLFAFRGQYCYELDEKAVRPGYPKLIRDVW  200
     ||||||||||||||||||||||||||||||||||||||||||||||||||
151  AEEELCSGKPFDAFTDLKNGSLFAFRGQYCYELDEKAVRPGYPKLIRDVW  200
```

```
201  GIEGPIDAAFTRINCQGKTYLFK                  223
     |||||||||||||||||||||||
201  GIEGPIDAAFTRINCQGKTYLFK                  223
```

Expression of VTNC_HUMAN Vitronectin (Serum Spreading Factor, Somatomedin B, Complement S-Protein), T39971 Transcripts, which are Detectable by Amplicon as Depicted in Sequence Name T39971 junc23-33 (SEQ ID NO: 1003) in Normal and Cancerous Ovary Tissues Expression of VTNC_HUMAN vitronectin (serum spreading factor, somatomedin B, complement S-protein) transcripts detectable by or according to junc23-33, T39971 junc23-33 (SEQ ID NO:1003) amplicon(s) and T39971 junc23-33F (SEQ ID NO:1001) and T39971 junc23-33R (SEQ ID NO:1002) primers was measured by real time PCR. In parallel the expression of four housekeeping genes PBGD (GenBank Accession No. BC019323 (SEQ ID NO: 1036); amplicon—PBGD-amplicon (SEQ ID NO: 1039)), HPRT1 (GenBank Accession No. NM_000194 (SEQ ID NO:1040); amplicon—HPRT1-amplicon (SEQ ID NO:1044)), SDHA (GenBank Accession No. NM_004168 (SEQ ID NO:1032); amplicon—SDHA-amplicon (SEQ ID NO:1035)), and GAPDH (GenBank Accession No. BC026907; GAPDH amplicon (SEQ ID NO: 1047)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45-48, Table 1, above, "Tissue samples in testing panel"), to obtain a value of fold differential expression for each sample relative to median of the normal PM samples.

Figure 30:
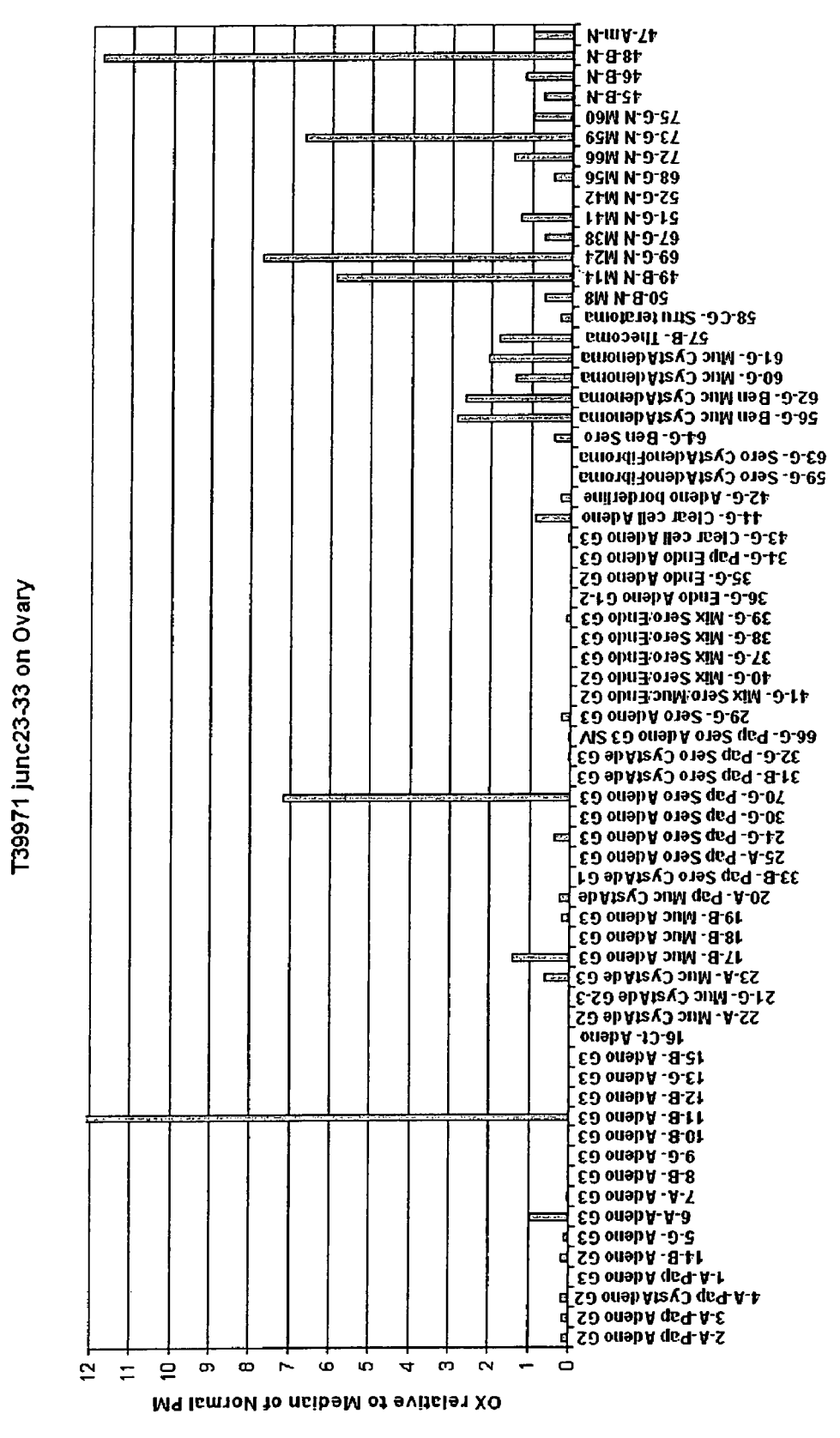
FIG. 30 is a histogram showing down regulation of T39971 junc23-33R (SEQ ID NO: 1003) transcripts in cancerous ovary samples relative to the normal samples.

FIG. 30 is a histogram showing down regulation of the above-indicated VTNC_HUMAN vitronectin (serum spreading factor, somatomedin B, complement S-protein), transcripts in cancerous ovary samples relative to the normal samples.

As is evident from FIG. 30, the expression of VTNC_HUMAN vitronectin (serum spreading factor, somatomedin B, complement S-protein), transcripts detectable by the above amplicon(s) in most cancer samples was significantly lower than in the non-cancerous samples (Sample Nos. 45-48 Table 1, above, "Tissue samples in testing panel").

Primer pairs are also optionally and preferably encompassed within the present invention; for example, for the above experiment, the following primer pair was used as a non-limiting illustrative example only of a suitable primer pair: T39971 junc23-33F (SEQ ID NO:1001) forward primer; and T39971 junc23-33R (SEQ ID NO:1002) reverse primer.

The present invention also preferably encompasses any amplicon obtained through the use of any suitable primer pair; for example, for the above experiment, the following amplicon was obtained as a non-limiting illustrative example only of a suitable amplicon: T39971 junc23-33 (SEQ ID NO:1003).

T39971 junc23-33 Forward primer (SEQ ID NO:1001): GGGGCAGAACCTCTGACAAG

T39971 junc23-33 Reverse primer (SEQ ID NO:1002): GGGCAGCCCAGCCAGTA

T39971 junc23-33 Amplicon (SEQ ID NO:1003): GGGGCAGAACCTCTGACAAGTACTAC-CGAGTCAATCTTCGCACACGGCGAGTGGAC ACT-GTGGACCCTCCCTACCCACGCTC-CATCGCTCAGTACTGGCTGGGCTGCCC Expression of VTNC_HUMAN Vitronectin (Serum Spreading Factor, Somatomedin B, Complement S-Protein), T39971 Transcripts, which are Detectable by Amplicon as Depicted in Sequence Name T39971junc23-33 (SEQ ID NO: 1003) in Different Normal Tissues Expression of VTNC_HUMAN vitronectin (serum spreading factor, somatomedin B, complement S-protein) transcripts detectable by or according to T39971junc23-33 (SEQ ID NO: 1003) amplicon and T39971junc23-33F (SEQ ID NO: 1001) and T39971junc23-33R (SEQ ID NO: 1002) was measured by real time PCR. In parallel the expression of four housekeeping genes—RPL19 (Genbank Accession No. NM_000981 (SEQ ID NO:1048); RPL19 amplicon (SEQ ID NO:1051)), TATA box (GenBank Accession No. NM_003194 (SEQ ID NO:1052); TATA amplicon (SEQ ID NO:1055)), Ubiquitin (GenBank Accession No. BC000449 (SEQ ID NO: 1056); amplicon—Ubiquitin-amplicon (SEQ ID NO: 1059)) and SDHA (GenBank Accession No. NM_004168 (SEQ ID NO:1032); amplicon—SDHA-amplicon (SEQ ID NO: 1035)) was measured similarly. For each RT sample, the expression of the above amplicon was normalized to the geometric mean of the quantities of the housekeeping genes. The normalized quantity of each RT sample was then divided by the median of the quantities of the breast samples (Sample Nos. 33-35, Table 2 "Tissue samples in normal panel" above), to obtain a value of relative expression of each sample relative to median of the breast samples.

Figure 31:
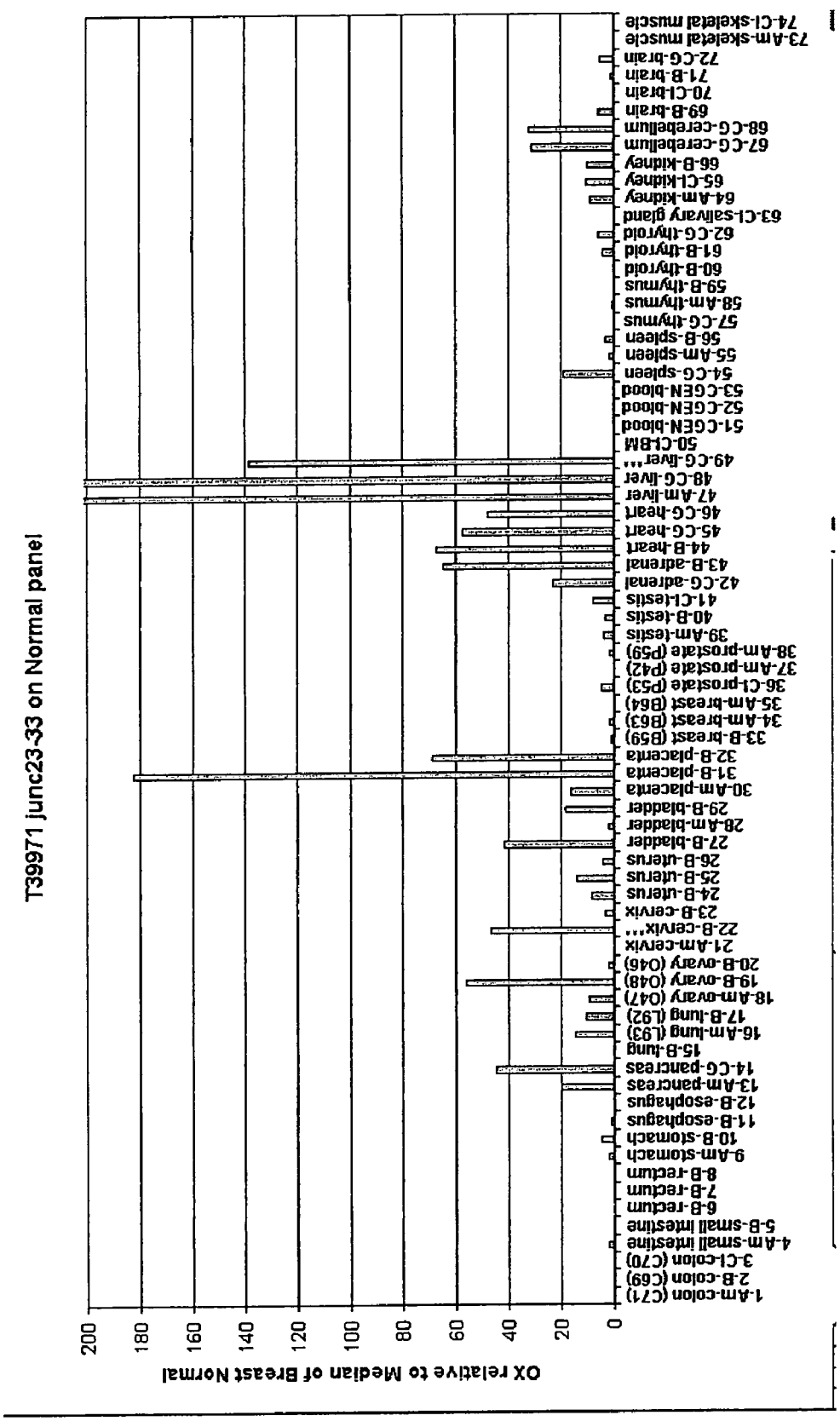
FIG. 31 is a histogram showing expression of T39971 junc23-33R (SEQ ID NO:1003) transcripts in normal tissues.

The results are described in FIG. 31, presenting the histogram showing the expression of T39971 transcripts, which are detectable by amplicon as depicted in sequence name T39971junc23-33 (SEQ ID NO:1003), in different normal tissues. Primers and amplicon are as above.

DESCRIPTION FOR CLUSTER Z44808

Cluster Z44808 features 5 transcript(s) and 21 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| Z44808_PEA_1_T11 | 607 |
| Z44808_PEA_1_T4 | 608 |
| Z44808_PEA_1_T5 | 609 |
| Z44808_PEA_1_T8 | 610 |
| Z44808_PEA_1_T9 | 611 |

TABLE 2

Segments of interest

| Segment Name | SEQ ID NO: |
|---|---|
| Z44808_PEA_1_node_0 | 612 |
| Z44808_PEA_1_node_16 | 613 |
| Z44808_PEA_1_node_2 | 614 |
| Z44808_PEA_1_node_24 | 615 |
| Z44808_PEA_1_node_32 | 616 |
| Z44808_PEA_1_node_33 | 617 |
| Z44808_PEA_1_node_36 | 618 |
| Z44808_PEA_1_node_37 | 619 |
| Z44808_PEA_1_node_41 | 620 |
| Z44808_PEA_1_node_11 | 621 |
| Z44808_PEA_1_node_13 | 622 |
| Z44808_PEA_1_node_18 | 623 |
| Z44808_PEA_1_node_22 | 624 |
| Z44808_PEA_1_node_26 | 625 |
| Z44808_PEA_1_node_30 | 626 |
| Z44808_PEA_1_node_34 | 627 |
| Z44808_PEA_1_node_35 | 628 |
| Z44808_PEA_1_node_39 | 629 |
| Z44808_PEA_1_node_4 | 630 |
| Z44808_PEA_1_node_6 | 631 |
| Z44808_PEA_1_node_8 | 632 |

TABLE 3

Proteins of interest

| Protein Name | SEQ ID NO: |
|---|---|
| Z44808_PEA_1_P5 | 634 |
| Z44808_PEA_1_P6 | 635 |
| Z44808_PEA_1_P7 | 636 |
| Z44808_PEA_1_P11 | 637 |

These sequences are variants of the known protein SPARC related modular calcium-binding protein 2 precursor (SwissProt accession identifier SMO2_HUMAN; known also according to the synonyms Secreted modular calcium-binding protein 2; SMOC-2; Smooth muscle-associated protein 2; SMAP-2; MSTP117), SEQ ID NO: 633, referred to herein as the previously known protein.

The sequence for protein SPARC related modular calcium-binding protein 2 precursor is given at the end of the application, as "SPARC related modular calcium-binding protein 2 precursor amino acid sequence". Known polymorphisms for this sequence are as shown in Table 4.

TABLE 4

Amino acid mutations for Known Protein

| SNP position(s) on amino acid sequence | Comment |
|---|---|
| 169-170 | KT -> TR |
| 212 | S -> P |
| 429-446 | TPRGHAESTSNRQPRKQG -> RSKRNL |
| 434 | A -> V |
| 439 | N -> Y |

Protein SPARC related modular calcium-binding protein 2 precursor localization is believed to be Secreted.

Cluster Z44808 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 32 refer to weighted expression of ESTs in each category, as "parts per million" (ratio of the expression of ESTs for a particular cluster to the expression of all ESTs in that category, according to parts per million).

Figure 32:
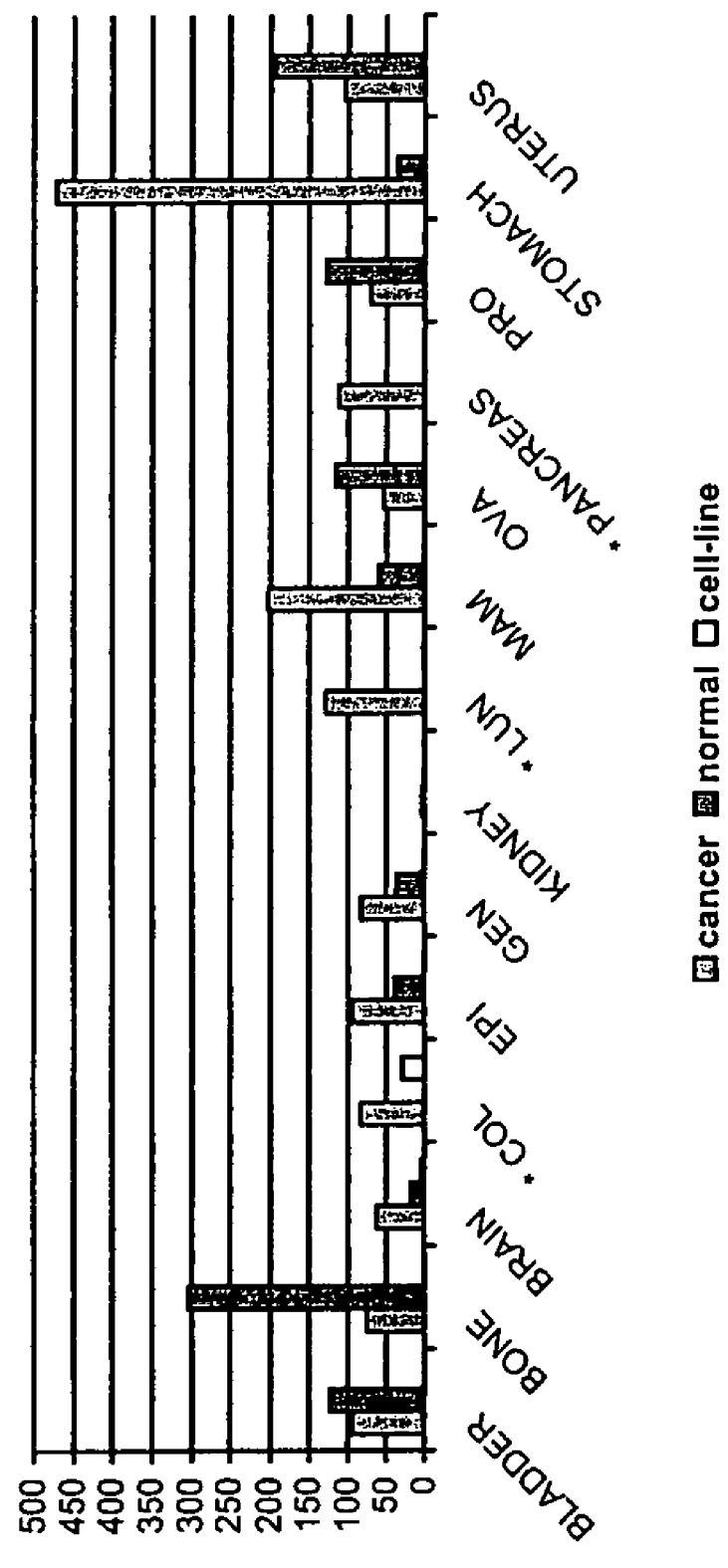
FIG. 32 shows cancer and cell-line vs. normal tissue expression.

Overall, the following results were obtained as shown with regard to the histograms in FIG. 32 and Table 5. This cluster is overexpressed (at least at a minimum level) in the following pathological conditions: colorectal cancer, lung cancer and pancreas carcinoma.

TABLE 5

Normal tissue distribution

| Name of Tissue | Number |
|---|---|
| bladder | 123 |
| bone | 304 |
| brain | 18 |
| colon | 0 |
| epithelial | 40 |
| general | 37 |
| kidney | 2 |
| lung | 0 |
| breast | 61 |
| ovary | 116 |
| pancreas | 0 |
| prostate | 128 |
| stomach | 36 |
| uterus | 195 |

TABLE 6

P values and ratios for expression in cancerous tissue

| Name of Tissue | P1 | P2 | SP1 | R3 | SP2 | R4 |
|---|---|---|---|---|---|---|
| bladder | 6.8e−01 | 7.6e−01 | 7.7e−01 | 0.8 | 9.1e−01 | 0.6 |
| bone | 7.0e−01 | 8.8e−01 | 9.9e−01 | 0.3 | 1 | 0.2 |
| brain | 6.8e−01 | 7.2e−01 | 3.0e−02 | 2.6 | 1.7e−01 | 1.6 |
| colon | 9.2e−03 | 1.3e−02 | 1.2e−01 | 3.6 | 1.6e−01 | 3.1 |
| epithelial | 2.1e−02 | 4.0e−01 | 1.0e−04 | 1.9 | 2.7e−01 | 1.0 |
| general | 2.6e−02 | 7.2e−01 | 4.9e−07 | 1.9 | 3.0e−01 | 1.0 |
| kidney | 7.3e−01 | 8.1e−01 | 1 | 1.0 | 1 | 1.0 |
| lung | 4.0e−03 | 1.8e−02 | 8.0e−04 | 12.2 | 2.1e−02 | 6.0 |
| breast | 4.8e−01 | 6.1e−01 | 9.8e−02 | 2.0 | 3.9e−01 | 1.2 |
| ovary | 8.1e−01 | 8.3e−01 | 9.1e−01 | 0.6 | 9.7e−01 | 0.5 |
| pancreas | 1.2e−01 | 2.1e−01 | 1.0e−03 | 6.5 | 5.9e−03 | 4.6 |
| prostate | 8.4e−01 | 8.9e−01 | 9.0e−01 | 0.6 | 9.8e−01 | 0.4 |
| stomach | 5.0e−01 | 8.7e−01 | 9.6e−04 | 1.5 | 1.9e−01 | 0.8 |
| uterus | 6.7e−01 | 7.9e−01 | 9.2e−01 | 0.5 | 1 | 0.3 |

As noted above, cluster Z44808 features 5 transcript(s), which were listed in Table 1 above. These transcript(s) encode for protein(s) which are variant(s) of protein SPARC related modular calcium-binding protein 2 precursor. A description of each variant protein according to the present invention is now provided.

Variant protein Z44808_PEA_1_P5 (SEQ ID NO: 634) according to the present invention has an amino acid sequence as given at the end of the application; it is encoded by transcript(s) Z44808_PEA_1_T4 (SEQ ID NO: 608). An alignment is given to the known protein (SPARC related modular calcium-binding protein 2 precursor) at the end of the application. One or more alignments to one or more previously published protein sequences are given at the end of the application. A brief description of the relationship of the variant protein according to the present invention to each such aligned protein is as follows:

Comparison report between Z44808_PEA_1_P5 (SEQ ID NO: 634) and SMO2_HUMAN:

1. An isolated chimeric polypeptide encoding for Z44808_PEA_1_P5 (SEQ ID NO: 634), comprising a first amino acid sequence being at least 90% homologous to MLL-PQLCWLPLLAGLLPPVPAQKFSALTFL-RVDQDKDKDCSLDCAGSPQKPLCASDGR TFLSRCEFQRAKCKDPQLEIAYRGNCKD-VSRCVAERKYTQEQARKEFQQVFIPECNDD GTYSQVQCHSYTGYCWCVTPNGRPISG-TAVAHKTPRCPGSVNEKLPQREGTGKTDDAA APALETQPQGDEEDIASRYPTLWTEQVK-SRQNKTNKNSVSSCDQEHQSALEEAKQPKN DNVVI-PECAHGGLYKPVQCHPSTGYCWCVLVDT-GRPIPGTSTRYEQPKCDNTARAHPA KARDLYKGRQLQGCPGAKKHEFLTSV-LDALSTDMVHAASDPSSSSGRLSEPDPSHTLEE RVVHWYFKLLDKNSSGDIGKKEIK-PFKRFLRKKSKPKKCVKKFVEYCDVNNDKSISVQ ELMGCLGVAKEDGKADTKKRHTPRGHAESTSNRQ corresponding to amino acids 1-441 of SMO2_HUMAN, which also corresponds to amino acids 1-441 of Z44808_PEA__1_P5 (SEQ ID NO: 634), and a second amino acid sequence being at least 70%, optionally at least 80%, preferably at least 85%, more preferably at least 90% and most preferably at least 95% homologous to a polypeptide having the sequence DAMVVSSRPKATTHRKSRTLSRR (SEQ ID NO: 1077) corresponding to amino acids 442-464 of Z44808_PEA__1_P5 (SEQ ID NO: 634), wherein said first and second amino acid sequences are contiguous and in a sequential order.

2. An isolated polypeptide encoding for a tail of Z44808_PEA__1_P5 (SEQ ID NO: 634), comprising a polypeptide being at least 70%, optionally at least about 80%, preferably at least about 85%, more preferably at least about 90% and most preferably at least about 95% homologous to the sequence DAMVVSSRPKATTHRKSRTLSRR (SEQ ID NO: 1077) in Z44808_PEA__1_P5 (SEQ ID NO: 634).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z44808_PEA__1_P5 (SEQ ID NO: 634) is encoded by the following transcript(s): Z44808_PEA__1_T4 (SEQ ID NO: 608), for which the sequence(s) is/are given at the end of the application. The coding portion of transcript Z44808_PEA__1_T4 (SEQ ID NO: 608) is shown in bold; this coding portion starts at position 586 and ends at position 1977. The transcript also has the following SNPs as listed in Table 7 (given according to their position on the nucleotide sequence, with the alternative nucleic acid listed; the last column indicates whether the SNP is known or not; the presence of known SNPs in variant protein Z44808_PEA__1_P5 (SEQ ID NO: 634) sequence provides support for the deduced sequence of this variant protein according to the present invention).

TABLE 7

Nucleic acid SNPs

| SNP position on nucleotide sequence | Alternative nucleic acid | Previously known SNP? |
| --- | --- | --- |
| 549 | A -> G | No |
| 648 | T -> G | No |
| 4403 | G -> T | No |

TABLE 7-continued

Nucleic acid SNPs

| SNP position on nucleotide sequence | Alternative nucleic acid | Previously known SNP? |
| --- | --- | --- |
| 4456 | G -> A | Yes |
| 4964 | G -> C | Yes |
| 1025 | C -> | No |
| 1677 | T -> C | No |
| 2691 | C -> T | Yes |
| 3900 | T -> C | No |
| 3929 | G -> A | Yes |
| 4099 | G -> T | Yes |
| 4281 | T -> C | No |
| 4319 | G -> C | Yes |

Variant protein Z44808_PEA__1_P6 (SEQ ID NO: 635) according to the present invention has an amino acid sequence as given at the end of the application; it is encoded by transcript(s) Z44808_PEA__1_T5 (SEQ ID NO: 609). An alignment is given to the known protein (SPARC related modular calcium-binding protein 2 precursor) at the end of the application. One or more alignments to one or more previously published protein sequences are given at the end of the application. A brief description of the relationship of the variant protein according to the present invention to each such aligned protein is as follows:

Comparison report between Z44808_PEA__1_P6 (SEQ ID NO: 635) and SMO2_HUMAN:

1. An isolated chimeric polypeptide encoding for Z44808_PEA__1_P6 (SEQ ID NO: 635), comprising a first amino acid sequence being at least 90% homologous to MLL-PQLCWLPLLAGLLPPVPAQKFSALTFL-RVDQDKDKDCSLDCAGSPQKPLCASDGR TFLSRCEFQRAKCKDPQLEIAYRGNCKD-VSRCVAERKYTQEQARKEFQQVFIPECNDD GTYSQVQCHSYTGYCWCVTPNGRPISG-TAVAHKTPRCPGSVNEKLPQREGTGKTDDAA APALETQPQGDEEDIASRYPTLWTEQVK-SRQNKTNKNSVSSCDQEHQSALEEAKQPKN DNVVI-PECAHGGLYKPVQCHPSTGYCWCVLVDT-GRPIPGTSTRYEQPKCDNTARAHPA KARDLYKGRQLQGCPGAKKHEFLTSV-LDALSTDMVHAASDPSSSSGRLSEPDPSHTLEE RVVHWYFKLLDKNSSGDIGKKEIK-PFKRFLRKKSKPKKCVKKFVEYCDVNNDKSISVQ ELMGCLGVAKEDGKADTKKRH corresponding to amino acids 1-428 of SMO2_HUMAN, which also corresponds to amino acids 1-428 of Z44808_PEA__1_P6 (SEQ ID NO: 635), and a second amino acid sequence being at least 70%, optionally at least 80%, preferably at least 85%, more preferably at least 90% and most preferably at least 95% homologous to a polypeptide having the sequence RSKRNL (SEQ ID NO: 1078) corresponding to amino acids 429-434 of Z44808_PEA__1_P6 (SEQ ID NO: 635), wherein said first and second amino acid sequences are contiguous and in a sequential order.

2. An isolated polypeptide encoding for a tail of Z44808_PEA__1_P6 (SEQ ID NO: 635), comprising a polypeptide being at least 70%, optionally at least about 80%, preferably at least about 85%, more preferably at least about 90% and most preferably at least about 95% homologous to the sequence RSKRNL (SEQ ID NO: 1078) in Z44808_PEA__1_P6 (SEQ ID NO: 635).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z44808_PEA_1_P6 (SEQ ID NO: 635) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein Z44808_PEA_1_P6 (SEQ ID NO: 635) sequence provides support for the deduced sequence of this variant protein according to the present invention).

TABLE 8

Amino acid mutations

| SNP position(s) on amino acid sequence | Alternative amino acid(s) | Previously known SNP? |
|---|---|---|
| 147 | A -> | No |

Variant protein Z44808_PEA_1_P6 (SEQ ID NO: 635) is encoded by the following transcript(s): Z44808_PEA_1_T5 (SEQ ID NO: 609), for which the sequence(s) is/are given at the end of the application. The coding portion of transcript Z44808_PEA_1_T5 (SEQ ID NO: 609) is shown in bold; this coding portion starts at position 586 and ends at position 1887. The transcript also has the following SNPs as listed in Table 9 (given according to their position on the nucleotide sequence, with the alternative nucleic acid listed; the last column indicates whether the SNP is known or not; the presence of known SNPs in variant protein Z44808_PEA_1_P6 (SEQ ID NO: 635) sequence provides support for the deduced sequence of this variant protein according to the present invention).

TABLE 9

Nucleic acid SNPs

| SNP position on nucleotide sequence | Alternative nucleic acid | Previously known SNP? |
|---|---|---|
| 549 | A -> G | No |
| 648 | T -> G | No |
| 2866 | G -> A | Yes |
| 3374 | G -> C | Yes |
| 1025 | C -> | No |
| 1677 | T -> C | No |
| 2310 | T -> C | No |
| 2339 | G -> A | Yes |
| 2509 | G -> T | Yes |
| 2691 | T -> C | No |
| 2729 | G -> C | Yes |
| 2813 | G -> T | No |

Variant protein Z44808_PEA_1_P7 (SEQ ID NO: 636) according to the present invention has an amino acid sequence as given at the end of the application; it is encoded by transcript(s) Z44808_PEA_1_T9 (SEQ ID NO: 611). An alignment is given to the known protein (SPARC related modular calcium-binding protein 2 precursor) at the end of the application. One or more alignments to one or more previously published protein sequences are given at the end of the application. A brief description of the relationship of the variant protein according to the present invention to each such aligned protein is as follows:

Comparison report between Z44808_PEA_1_P7 (SEQ ID NO: 636) and SMO2_HUMAN:

1. An isolated chimeric polypeptide encoding for Z44808_PEA_1_P7 (SEQ ID NO: 636), comprising a first amino acid sequence being at least 90% homologous to MLL-PQLCWLPLLAGLLPPVPAQKFSALTFL-RVDQDKDKDCSLDCAGSPQKPLCASDGR TFLSRCEFQRAKCKDPQLEIAYRGNCKD-VSRCVAERKYTQEQARKEFQQVFIPECNDD GTYSQVQCHSYTGYCWCVTPNGRPISG-TAVAHKTPRCPGSVNEKLPQREGTGKTDDAA APALETQPQGDEEDIASRYPTLWTEQVK-SRQNKTNKNSVSSCDQEHQSALEEAKQPKN DNVVI-PECAHGGLYKPVQCHPSTGYCWCVLVDT-GRPIPGTSTRYEQPKCDNTARAHPA KARDLYKGRQLQGCPGAKKHEFLTSV-LDALSTDMVHAASDPSSSSGRLSEPDPSHTLEE RVVHWYFKLLDKNSSGDIGKKEIK-PFKRFLRKKSKPKKCVKKFVEYCDVNNDKSISVQ ELMGCLGVAKEDGKADTKKRHTPRGHAESTSNRQ corresponding to amino acids 1-441 of SMO2_HUMAN, which also corresponds to amino acids 1-441 of Z44808_PEA_1_P7 (SEQ ID NO: 636), and a second amino acid sequence being at least 70%, optionally at least 80%, preferably at least 85%, more preferably at least 90% and most preferably at least 95% homologous to a polypeptide having the sequence LLWLRGKVSFYCF (SEQ ID NO: 1079) corresponding to amino acids 442-454 of Z44808_PEA_1_P7 (SEQ ID NO: 636), wherein said first and second amino acid sequences are contiguous and in a sequential order.

2. An isolated polypeptide encoding for a tail of Z44808_PEA_1_P7 (SEQ ID NO: 636), comprising a polypeptide being at least 70%, optionally at least about 80%, preferably at least about 85%, more preferably at least about 90% and most preferably at least about 95% homologous to the sequence LLWLRGKVSFYCF (SEQ ID NO: 1079) in Z44808_PEA_1_P7 (SEQ ID NO: 636).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z44808_PEA_1_P7 (SEQ ID NO: 636) also has the following non-silent SNPs (Single Nucleotide Polymorphisms) as listed in Table 10, (given according to their position(s) on the amino acid sequence, with the alternative amino acid(s) listed; the last column indicates whether the SNP is known or not; the presence of known SNPs in variant protein Z44808_PEA_1_P7 (SEQ ID NO: 636) sequence provides support for the deduced sequence of this variant protein according to the present invention).

TABLE 10

Amino acid mutations

| SNP position(s) on amino acid sequence | Alternative amino acid(s) | Previously known SNP? |
|---|---|---|
| 147 | A -> | No |

Variant protein Z44808_PEA_1_P7 (SEQ ID NO: 636) is encoded by the following transcript(s): Z44808_PEA_1_T9 (SEQ ID NO: 611), for which the sequence(s) is/are given at the end of the application. The coding portion of transcript Z44808_PEA_1_T9 (SEQ ID NO: 611) is shown in bold; this coding portion starts at position 586 and ends at position 1947. The transcript also has the following SNPs as listed in Table 11 (given according to their position on the nucleotide sequence, with the alternative nucleic acid listed; the last column indicates whether the SNP is known or not; the presence of known SNPs in variant protein Z44808_PEA_1_P7 (SEQ ID NO: 636) sequence provides support for the deduced sequence of this variant protein according to the present invention).

TABLE 11

Nucleic acid SNPs

| SNP position on nucleotide sequence | Alternative nucleic acid | Previously known SNP? |
|---|---|---|
| 549 | A -> G | No |
| 648 | T -> G | No |
| 1025 | C -> | No |
| 1677 | T -> C | No |
| 2169 | C -> A | Yes |

Variant protein Z44808_PEA_1_P11 (SEQ ID NO: 637) according to the present invention has an amino acid sequence as given at the end of the application; it is encoded by transcript(s) Z44808_PEA_1_T11 (SEQ ID NO: 607). The identification of this transcript was performed using a non-EST based method for identification of alternative splicing, described in the following reference: "Sorek R et al., Genome Res. (2004) 14:1617-23." An alignment is given to the known protein (SPARC related modular calcium-binding protein 2 precursor) at the end of the application. One or more alignments to one or more previously published protein sequences are given at the end of the application. A brief description of the relationship of the variant protein according to the present invention to each such aligned protein is as follows:

Comparison report between Z44808_PEA_1_P11 (SEQ ID NO: 637) and SMO2_HUMAN:

1. An isolated chimeric polypeptide encoding for Z44808_PEA_1_P11 (SEQ ID NO: 637), comprising a first amino acid sequence being at least 90% homologous to MLLPQLCWLPLLAGLLPPVPAQKFSALTFL-RVDQDKDKDCSLDCAGSPQKPLCASDGR TFLSRCEFQRAKCKDPQLEIAYRGNCKD-VSRCVAERKYTQEQARKEFQQVFIPECNDD GTYSQVQCHSYTGYCWCVTPNGRPISG-TAVAHKTPRCPGSVNEKLPQREGTGKT corresponding to amino acids 1-170 of SMO2_HUMAN, which also corresponds to amino acids 1-170 of Z44808_PEA_1_P11 (SEQ ID NO: 637), and a second amino acid sequence being at least 90% homologous to DIASRYPTLWTEQVKSRQNKT-NKNSVSSCDQEHQSALEEAKQPKNDNV-VIPECAHGGL YKPVQCHPSTGYCWCVLVDT-GRPIPGTSTRYEQPKCDNTARAHPAKARDLYKGRQLQ GCPGAKKHEFLTSVLDALSTDMVHAAS-DPSSSSGRLSEPDPSHTLEERVVHWYFKLLD KNSSG-DIGKKEIKPFKRFLRKKSKP-KKCVKKFVEYCDVNNDKSISVQELMGCLGVAKE DGKADTKKRHTPRGHAESTSNRQPRKQG corresponding to amino acids 188-446 of SMO2_HUMAN, which also corresponds to amino acids 171-429 of Z44808_PEA_1_P11 (SEQ ID NO: 637), wherein said first and second amino acid sequences are contiguous and in a sequential order.

2. An isolated chimeric polypeptide encoding for an edge portion of Z44808_PEA_1_P11 (SEQ ID NO: 637), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TD, having a structure as follows: a sequence starting from any of amino acid numbers 170−x to −170; and ending at any of amino acid numbers 171+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z44808_PEA_1_P11 (SEQ ID NO: 637) also has the following non-silent SNPs (Single Nucleotide Polymorphisms) as listed in Table 12, (given according to their position(s) on the amino acid sequence, with the alternative amino acid(s) listed; the last column indicates whether the SNP is known or not; the presence of known SNPs in variant protein Z44808_PEA_1_P11 (SEQ ID NO: 637) sequence provides support for the deduced sequence of this variant protein according to the present invention).

TABLE 12

Amino acid mutations

| SNP position(s) on amino acid sequence | Alternative amino acid(s) | Previously known SNP? |
|---|---|---|
| 147 | A -> | No |

Variant protein Z44808_PEA_1_P11 (SEQ ID NO: 637) is encoded by the following transcript(s): Z44808_PEA_1_T11 (SEQ ID NO: 607), for which the sequence(s) is/are given at the end of the application. The coding portion of transcript Z44808_PEA_1_T11 (SEQ ID NO: 607) is shown in bold; this coding portion starts at position 586 and ends at position 1872. The transcript also has the following SNPs as listed in Table 13 (given according to their position on the nucleotide sequence, with the alternative nucleic acid listed; the last column indicates whether the SNP is known or not; the presence of known SNPs in variant protein Z44808_PEA_1_P11 (SEQ ID NO: 637) sequence provides support for the deduced sequence of this variant protein according to the present invention).

TABLE 13

Nucleic acid SNPs

| SNP position on nucleotide sequence | Alternative nucleic acid | Previously known SNP? |
|---|---|---|
| 549 | A -> G | No |
| 648 | T -> G | No |
| 2720 | G -> A | Yes |
| 3228 | G -> C | Yes |
| 1025 | C -> | No |
| 1626 | T -> C | No |
| 2164 | T -> C | No |
| 2193 | G -> A | Yes |
| 2363 | G -> T | Yes |
| 2545 | T -> C | No |
| 2583 | G -> C | Yes |
| 2667 | G -> T | No |

As noted above, cluster Z44808 features 21 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster Z44808_PEA_1_node_0 (SEQ ID NO: 612) according to the present invention is supported by 29 libraries. The number of libraries was determined as previously described. This segment can be found in the following transcript(s): Z44808_PEA_1_T11 (SEQ ID NO: 607), Z44808_PEA_1_T4 (SEQ ID NO: 608), Z44808_PEA_1_T5 (SEQ ID NO: 609), Z44808_PEA_1_T8 (SEQ ID NO: 610) and Z44808_PEA_1_T9 (SEQ ID NO: 611). Table 14 below describes the starting and ending position of this segment on each transcript.

TABLE 14

Segment location on transcripts

| Transcript name | Segment starting position | Segment ending position |
|---|---|---|
| Z44808_PEA_1_T11 (SEQ ID NO:607) | 1 | 669 |
| Z44808_PEA_1_T4 (SEQ ID NO:608) | 1 | 669 |
| Z44808_PEA_1_T5 (SEQ ID NO:609) | 1 | 669 |
| Z44808_PEA_1_T8 (SEQ ID NO:610) | 1 | 669 |
| Z44808_PEA_1_T9 (SEQ ID NO:611) | 1 | 669 |

Segment cluster Z44808_PEA_1_node_16 (SEQ ID NO: 613) according to the present invention is supported by 39 libraries. The number of libraries was determined as previously described. This segment can be found in the following transcript(s): Z44808_PEA_1_T11 (SEQ ID NO: 607), Z44808_PEA_1_T4 (SEQ ID NO: 608), Z44808_PEA_1_T5 (SEQ ID NO: 609), Z44808_PEA_1_T8 (SEQ ID NO: 610) and Z44808_PEA_1_T9 (SEQ ID NO: 611). Table 15 below describes the starting and ending position of this segment on each transcript.

TABLE 15

Segment location on transcripts

| Transcript name | Segment starting position | Segment ending position |
|---|---|---|
| Z44808_PEA_1_T11 (SEQ ID NO:607) | 1172 | 1358 |
| Z44808_PEA_1_T4 (SEQ ID NO:608) | 1223 | 1409 |
| Z44808_PEA_1_T5 (SEQ ID NO:609) | 1223 | 1409 |
| Z44808_PEA_1_T8 (SEQ ID NO:610) | 1223 | 1409 |
| Z44808_PEA_1_T9 (SEQ ID NO:611) | 1223 | 1409 |

Segment cluster Z44808_PEA_1_node_2 (SEQ ID NO: 614) according to the present invention is supported by 34 libraries. The number of libraries was determined as previously described. This segment can be found in the following transcript(s): Z44808_PEA_1_T11 (SEQ ID NO: 607), Z44808_PEA_1_T4 (SEQ ID NO: 608), Z44808_PEA_1_T5 (SEQ ID NO: 609), Z44808_PEA_1_T8 (SEQ ID NO: 610) and Z44808_PEA_1_T9 (SEQ ID NO: 611). Table 16 below describes the starting and ending position of this segment on each transcript.

TABLE 16

Segment location on transcripts

| Transcript name | Segment starting position | Segment ending position |
|---|---|---|
| Z44808_PEA_1_T11 (SEQ ID NO:607) | 670 | 841 |
| Z44808_PEA_1_T4 (SEQ ID NO:608) | 670 | 841 |
| Z44808_PEA_1_T5 (SEQ ID NO:609) | 670 | 841 |
| Z44808_PEA_1_T8 (SEQ ID NO:610) | 670 | 841 |
| Z44808_PEA_1_T9 (SEQ ID NO:611) | 670 | 841 |

Segment cluster Z44808_PEA_1_node_24 (SEQ ID NO: 615) according to the present invention is supported by 52 libraries. The number of libraries was determined as previously described. This segment can be found in the following transcript(s): Z44808_PEA_1_T11 (SEQ ID NO: 607), Z44808_PEA_1_T4 (SEQ ID NO: 608), Z44808_PEA_1_T5 (SEQ ID NO: 609), Z44808_PEA_1_T8 (SEQ ID NO: 610) and Z44808_PEA_1_T9 (SEQ ID NO: 611). Table 17 below describes the starting and ending position of this segment on each transcript.

TABLE 17

Segment location on transcripts

| Transcript name | Segment starting position | Segment ending position |
|---|---|---|
| Z44808_PEA_1_T11 (SEQ ID NO:607) | 1545 | 1819 |
| Z44808_PEA_1_T4 (SEQ ID NO:608) | 1596 | 1870 |
| Z44808_PEA_1_T5 (SEQ ID NO:609) | 1596 | 1870 |
| Z44808_PEA_1_T8 (SEQ ID NO:610) | 1596 | 1870 |

TABLE 17-continued

Segment location on transcripts

| Transcript name | Segment starting position | Segment ending position |
|---|---|---|
| Z44808_PEA_1_T9 (SEQ ID NO:611) | 1596 | 1870 |

Segment cluster Z44808_PEA_1_node_32 (SEQ ID NO: 616) according to the present invention is supported by 17 libraries. The number of libraries was determined as previously described. This segment can be found in the following transcript(s): Z44808_PEA_1_T4 (SEQ ID NO: 608) and Z44808_PEA_1_T8 (SEQ ID NO: 610). Table 18 below describes the starting and ending position of this segment on each transcript.

TABLE 18

Segment location on transcripts

| Transcript name | Segment starting position | Segment ending position |
|---|---|---|
| Z44808_PEA_1_T4 (SEQ ID NO:608) | 1909 | 3593 |
| Z44808_PEA_1_T8 (SEQ ID NO:610) | 1909 | 2397 |

Segment cluster Z44808_PEA_1_node_33 (SEQ ID NO: 617) according to the present invention is supported by 133 libraries. The number of libraries was determined as previously described. This segment can be found in the following transcript(s): Z44808_PEA_1_T11 (SEQ ID NO: 607), Z44808_PEA_1_T4 (SEQ ID NO: 608) and Z44808_PEA_1_T5 (SEQ ID NO: 609). Table 20 below describes the starting and ending position of this segment on each transcript.

TABLE 20

Segment location on transcripts

| Transcript name | Segment starting position | Segment ending position |
|---|---|---|
| Z44808_PEA_1_T11 (SEQ ID NO:607) | 1858 | 2734 |
| Z44808_PEA_1_T4 (SEQ ID NO:608) | 3594 | 4470 |
| Z44808_PEA_1_T5 (SEQ ID NO:609) | 2004 | 2880 |

Segment cluster Z44808_PEA_1_node_36 (SEQ ID NO: 618) according to the present invention is supported by 117 libraries. The number of libraries was determined as previously described. This segment can be found in the following transcript(s): Z44808_PEA_1_T11 (SEQ ID NO: 607), Z44808_PEA_1_T4 (SEQ ID NO: 608) and Z44808_PEA_1_T5 (SEQ ID NO: 609). Table 21 below describes the starting and ending position of this segment on each transcript.

TABLE 21

Segment location on transcripts

| Transcript name | Segment starting position | Segment ending position |
|---|---|---|
| Z44808_PEA_1_T11 (SEQ ID NO:607) | 2829 | 3080 |

TABLE 21-continued

Segment location on transcripts

| Transcript name | Segment starting position | Segment ending position |
|---|---|---|
| Z44808_PEA_1_T4 (SEQ ID NO:608) | 4565 | 4816 |
| Z44808_PEA_1_T5 (SEQ ID NO:609) | 2975 | 3226 |

Segment cluster Z44808_PEA_1_node_37 (SEQ ID NO: 619) according to the present invention is supported by 120 libraries. The number of libraries was determined as previously described. This segment can be found in the following transcript(s): Z44808_PEA_1_T11 (SEQ ID NO: 607), Z44808_PEA_1_T4 (SEQ ID NO: 608) and Z44808_PEA_1_T5 (SEQ ID NO: 609). Table 22 below describes the starting and ending position of this segment on each transcript.

TABLE 22

Segment location on transcripts

| Transcript name | Segment starting position | Segment ending position |
|---|---|---|
| Z44808_PEA_1_T11 (SEQ ID NO: 607) | 3081 | 3429 |
| Z44808_PEA_1_T4 (SEQ ID NO: 608) | 4817 | 5165 |
| Z44808_PEA_1_T5 (SEQ ID NO: 609) | 3227 | 3575 |

Segment cluster Z44808_PEA_1_node_4 (SEQ ID NO: 630) Z44808_PEA_1_node_4 (SEQ ID NO: 630)1 (SEQ ID NO: 620) according to the present invention is supported by 2 libraries. The number of libraries was determined as previously described. This segment can be found in the following transcript(s): Z44808_PEA_1_T9 (SEQ ID NO: 611). Table 23 below describes the starting and ending position of this segment on each transcript.

TABLE 23

Segment location on transcripts

| Transcript name | Segment starting position | Segment ending position |
|---|---|---|
| Z44808_PEA_1_T9 (SEQ ID NO: 611) | 1974 | 2206 |

According to an optional embodiment of the present invention, short segments related to the above cluster are also provided. These segments are up to about 120 bp in length, and so are included in a separate description.

Segment cluster Z44808_PEA_1_node_11 (SEQ ID NO: 621) according to the present invention is supported by 25 libraries. The number of libraries was determined as previously described. This segment can be found in the following transcript(s): Z44808_PEA_1_T4 (SEQ ID NO: 608), Z44808_PEA_1_T5 (SEQ ID NO: 609), Z44808_PEA_1_T8 (SEQ ID NO: 610) and Z44808_PEA_1_T9 (SEQ ID NO: 611). Table 24 below describes the starting and ending position of this segment on each transcript.

TABLE 24

Segment location on transcripts

| Transcript name | Segment starting position | Segment ending position |
|---|---|---|
| Z44808_PEA_1_T4 (SEQ ID NO: 608) | 1097 | 1147 |
| Z44808_PEA_1_T5 (SEQ ID NO: 609) | 1097 | 1147 |
| Z44808_PEA_1_T8 (SEQ ID NO: 610) | 1097 | 1147 |
| Z44808_PEA_1_T9 (SEQ ID NO: 611) | 1097 | 1147 |

Segment cluster Z44808_PEA_1_node_13 (SEQ ID NO: 622) according to the present invention is supported by 28 libraries. The number of libraries was determined as previously described. This segment can be found in the following transcript(s): Z44808_PEA_1_T11 (SEQ ID NO: 607), Z44808_PEA_1_T4 (SEQ ID NO: 608), Z44808_PEA_1_T5 (SEQ ID NO: 609), Z44808_PEA_1_T8 (SEQ ID NO: 610) and Z44808_PEA_1_T9 (SEQ ID NO: 611). Table 25 below describes the starting and ending position of this segment on each transcript.

TABLE 25

Segment location on transcripts

| Transcript name | Segment starting position | Segment ending position |
|---|---|---|
| Z44808_PEA_1_T11 (SEQ ID NO: 607) | 1097 | 1171 |
| Z44808_PEA_1_T4 (SEQ ID NO: 608) | 1148 | 1222 |
| Z44808_PEA_1_T5 (SEQ ID NO: 609) | 1148 | 1222 |
| Z44808_PEA_1_T8 (SEQ ID NO: 610) | 1148 | 1222 |
| Z44808_PEA_1_T9 (SEQ ID NO: 611) | 1148 | 1222 |

Segment cluster Z44808_PEA_1_node_18 (SEQ ID NO: 623) according to the present invention is supported by 27 libraries. The number of libraries was determined as previously described. This segment can be found in the following transcript(s): Z44808_PEA_1_T11 (SEQ ID NO: 607), Z44808_PEA_1_T4 (SEQ ID NO: 608), Z44808_PEA_1_T5 (SEQ ID NO: 609), Z44808_PEA_1_T8 (SEQ ID NO: 610) and Z44808_PEA_1_T9 (SEQ ID NO: 611). Table 26 below describes the starting and ending position of this segment on each transcript.

TABLE 26

Segment location on transcripts

| Transcript name | Segment starting position | Segment ending position |
|---|---|---|
| Z44808_PEA_1_T11 (SEQ ID NO: 607) | 1359 | 1441 |
| Z44808_PEA_1_T4 (SEQ ID NO: 608) | 1410 | 1492 |
| Z44808_PEA_1_T5 (SEQ ID NO: 609) | 1410 | 1492 |
| Z44808_PEA_1_T8 (SEQ ID NO: 610) | 1410 | 1492 |
| Z44808_PEA_1_T9 (SEQ ID NO: 611) | 1410 | 1492 |

Segment cluster Z44808_PEA_1_node_22 (SEQ ID NO: 624) according to the present invention is supported by 33 libraries. The number of libraries was determined as previously described. This segment can be found in the following transcript(s): Z44808_PEA_1_T11 (SEQ ID NO: 607), Z44808_PEA_1_T4 (SEQ ID NO: 608), Z44808_PEA_1_T5 (SEQ ID NO: 609), Z44808_PEA_1_T8 (SEQ ID NO: 610) and Z44808_PEA_1_T9 (SEQ ID NO: 611). Table 27 below describes the starting and ending position of this segment on each transcript.

TABLE 27

Segment location on transcripts

| Transcript name | Segment starting position | Segment ending position |
|---|---|---|
| Z44808_PEA_1_T11 (SEQ ID NO: 607) | 1442 | 1544 |
| Z44808_PEA_1_T4 (SEQ ID NO: 608) | 1493 | 1595 |
| Z44808_PEA_1_T5 (SEQ ID NO: 609) | 1493 | 1595 |
| Z44808_PEA_1_T8 (SEQ ID NO: 610) | 1493 | 1595 |
| Z44808_PEA_1_T9 (SEQ ID NO: 611) | 1493 | 1595 |

Segment cluster Z44808_PEA_1_node_26 (SEQ ID NO: 625) according to the present invention is supported by 2 libraries. The number of libraries was determined as previously described. This segment can be found in the following transcript(s): Z44808_PEA_1_T5 (SEQ ID NO: 609). Table 29 below describes the starting and ending position of this segment on each transcript.

TABLE 29

Segment location on transcripts

| Transcript name | Segment starting position | Segment ending position |
|---|---|---|
| Z44808_PEA_1_T5 (SEQ ID NO: 609) | 1871 | 1965 |

Segment cluster Z44808_PEA_1_node_30 (SEQ ID NO: 626) according to the present invention is supported by 44 libraries. The number of libraries was determined as previously described. This segment can be found in the following transcript(s): Z44808_PEA_1_T11 (SEQ ID NO: 607), Z44808_PEA_1_T4 (SEQ ID NO: 608), Z44808_PEA_1_T5 (SEQ ID NO: 609), Z44808_PEA_1_T8 (SEQ ID NO: 610) and Z44808_PEA_1_T9 (SEQ ID NO: 611). Table 31 below describes the starting and ending position of this segment on each transcript.

TABLE 31

Segment location on transcripts

| Transcript name | Segment starting position | Segment ending position |
|---|---|---|
| Z44808_PEA_1_T11 (SEQ ID NO: 607) | 1820 | 1857 |
| Z44808_PEA_1_T4 (SEQ ID NO: 608) | 1871 | 1908 |
| Z44808_PEA_1_T5 (SEQ ID NO: 609) | 1966 | 2003 |
| Z44808_PEA_1_T8 (SEQ ID NO: 610) | 1871 | 1908 |
| Z44808_PEA_1_T9 (SEQ ID NO: 611) | 1871 | 1908 |

Segment cluster Z44808_PEA_1_node_34 (SEQ ID NO: 627) according to the present invention is supported by 70 libraries. The number of libraries was determined as previously described. This segment can be found in the following transcript(s): Z44808_PEA_1_T11 (SEQ ID NO: 607), Z44808_PEA_1_T4 (SEQ ID NO: 608) and Z44808_PEA_1_T5 (SEQ ID NO: 609). Table 32 below describes the starting and ending position of this segment on each transcript.

TABLE 32

Segment location on transcripts

| Transcript name | Segment starting position | Segment ending position |
|---|---|---|
| Z44808_PEA_1_T11 (SEQ ID NO: 607) | 2735 | 2809 |
| Z44808_PEA_1_T4 (SEQ ID NO: 608) | 4471 | 4545 |
| Z44808_PEA_1_T5 (SEQ ID NO: 609) | 2881 | 2955 |

Segment cluster Z44808_PEA_1_node_35 (SEQ ID NO: 628) according to the present invention can be found in the following transcript(s): Z44808_PEA_1_T11 (SEQ ID NO: 607), Z44808_PEA_1_T4 (SEQ ID NO: 608) and Z44808_PEA_1_T5 (SEQ ID NO: 609). Table 33 below describes the starting and ending position of this segment on each transcript.

TABLE 33

Segment location on transcripts

| Transcript name | Segment starting position | Segment ending position |
|---|---|---|
| Z44808_PEA_1_T11 (SEQ ID NO: 607) | 2810 | 2828 |
| Z44808_PEA_1_T4 (SEQ ID NO: 608) | 4546 | 4564 |
| Z44808_PEA_1_T5 (SEQ ID NO: 609) | 2956 | 2974 |

Segment cluster Z44808_PEA_1_node_39 (SEQ ID NO: 629) according to the present invention is supported by 1 libraries. The number of libraries was determined as previously described. This segment can be found in the following transcript(s): Z44808_PEA_1_T9 (SEQ ID NO: 611). Table 34 below describes the starting and ending position of this segment on each transcript.

TABLE 34

Segment location on transcripts

| Transcript name | Segment starting position | Segment ending position |
|---|---|---|
| Z44808_PEA_1_T9 (SEQ ID NO: 611) | 1909 | 1973 |

Segment cluster Z44808_PEA_1_node_4 (SEQ ID NO: 630) according to the present invention is supported by 33 libraries. The number of libraries was determined as previously described. This segment can be found in the following transcript(s): Z44808_PEA_1_T11 (SEQ ID NO: 607), Z44808_PEA_1_T4 (SEQ ID NO: 608), Z44808_PEA_1_T5 (SEQ ID NO: 609), Z44808_PEA_1_T8 (SEQ ID NO: 610) and Z44808_PEA_1_T9 (SEQ ID NO: 611). Table 35 below describes the starting and ending position of this segment on each transcript.

TABLE 35

Segment location on transcripts

| Transcript name | Segment starting position | Segment ending position |
|---|---|---|
| Z44808_PEA_1_T11 (SEQ ID NO: 607) | 842 | 948 |
| Z44808_PEA_1_T4 (SEQ ID NO: 608) | 842 | 948 |
| Z44808_PEA_1_T5 (SEQ ID NO: 609) | 842 | 948 |
| Z44808_PEA_1_T8 (SEQ ID NO: 610) | 842 | 948 |
| Z44808_PEA_1_T9 (SEQ ID NO: 611) | 842 | 948 |

Segment cluster Z44808_PEA_1_node_6 (SEQ ID NO: 631) according to the present invention is supported by 30 libraries. The number of libraries was determined as previously described. This segment can be found in the following transcript(s): Z44808_PEA_1_T11 (SEQ ID NO: 607), Z44808_PEA_1_T4 (SEQ ID NO: 608), Z44808_PEA_1_T5 (SEQ ID NO: 609), Z44808_PEA_1_T8 (SEQ ID NO: 610) and Z44808_PEA_1_T9 (SEQ ID NO: 611). Table 36 below describes the starting and ending position of this segment on each transcript.

TABLE 36

Segment location on transcripts

| Transcript name | Segment starting position | Segment ending position |
|---|---|---|
| Z44808_PEA_1_T11 (SEQ ID NO: 607) | 949 | 1048 |
| Z44808_PEA_1_T4 (SEQ ID NO: 608) | 949 | 1048 |
| Z44808_PEA_1_T5 (SEQ ID NO: 609) | 949 | 1048 |
| Z44808_PEA_1_T8 (SEQ ID NO: 610) | 949 | 1048 |
| Z44808_PEA_1_T9 (SEQ ID NO: 611) | 949 | 1048 |

Segment cluster Z44808_PEA_1_node_8 (SEQ ID NO: 632) according to the present invention is supported by 25 libraries. The number of libraries was determined as previously described. This segment can be found in the following transcript(s): Z44808_PEA_1_T11 (SEQ ID NO: 607), Z44808_PEA_1_T4 (SEQ ID NO: 608), Z44808_PEA_1_T5 (SEQ ID NO: 609), Z44808_PEA_1_T8 (SEQ ID NO: 610) and Z44808_PEA_1_T9 (SEQ ID NO: 611). Table 37 below describes the starting and ending position of this segment on each transcript.

TABLE 37

Segment location on transcripts

| Transcript name | Segment starting position | Segment ending position |
|---|---|---|
| Z44808_PEA_1_T11 (SEQ ID NO: 607) | 1049 | 1096 |
| Z44808_PEA_1_T4 (SEQ ID NO: 608) | 1049 | 1096 |
| Z44808_PEA_1_T5 (SEQ ID NO: 609) | 1049 | 1096 |
| Z44808_PEA_1_T8 (SEQ ID NO: 610) | 1049 | 1096 |
| Z44808_PEA_1_T9 (SEQ ID NO: 611) | 1049 | 1096 |

Variant protein alignment to the previously known protein:

Sequence name: /tmp/vUqLu6eAVZ/K3JDuPvaLo:SMO2_HUMAN

Sequence documentation:

Alignment of: Z44808_PEA_1_P5 (SEQ ID NO: 634) x SMO2_HUMAN . . .

Alignment segment 1/1:

Quality: 4440.00

Escore: 0

Matching length: 441 Total length: 441

Matching Percent Similarity: 100.00 Matching Percent Identity: 100.00

Total Percent Similarity: 100.00 Total Percent Identity: 100.00

Gaps: 0

Alignment:

```
  1 MLLPQLCWLPLLAGLLPPVPAQKFSALTFLRVDQDKDKDCSLDCAGSPQK  50
    ||||||||||||||||||||||||||||||||||||||||||||||||||
  1 MLLPQLCWLPLLAGLLPPVPAQKFSALTFLRVDQDKDKDCSLDCAGSPQK  50

51 PLCASDGRTFLSRCEFQRAKCKDPQLEIAYRGNCKDVSRCVAERKYTQEQ 100
    ||||||||||||||||||||||||||||||||||||||||||||||||||
 51 PLCASDGRTFLSRCEFQRAKCKDPQLEIAYRGNCKDVSRCVAERKYTQEQ 100

101 ARKEFQQVFIPECNDDGTYSQVQCHSYTGYCWCVTPNGRPISGTAVAHKT 150
    ||||||||||||||||||||||||||||||||||||||||||||||||||
101 ARKEFQQVFIPECNDDGTYSQVQCHSYTGYCWCVTPNGRPISGTAVAHKT 150

151 PRCPGSVNEKLPQREGTGKTDDAAAPALETQPQGDEEDIASRYPTLWTEQ 200
    ||||||||||||||||||||||||||||||||||||||||||||||||||
151 PRCPGSVNEKLPQREGTGKTDDAAAPALETQPQGDEEDIASRYPTLWTEQ 200

201 VKSRQNKTNKNSVSSCDQEHQSALEEAKQPKNDNVVIPECAHGGLYKPVQ 250
    ||||||||||||||||||||||||||||||||||||||||||||||||||
201 VKSRQNKTNKNSVSSCDQEHQSALEEAKQPKNDNVVIPECAHGGLYKPVQ 250

251 CHPSTGYCWCVLVDTGRPIPGTSTRYEQPKCDNTARAHPAKARDLYKGRQ 300
    ||||||||||||||||||||||||||||||||||||||||||||||||||
251 CHPSTGYCWCVLVDTGRPIPGTSTRYEQPKCDNTARAHPAKARDLYKGRQ 300
```

-continued

```
301 LQGCPGAKKHEFLTSVLDALSTDMVHAASDPSSSSGRLSEPDPSHTLEER 350
    ||||||||||||||||||||||||||||||||||||||||||||||||||
301 LQGCPGAKKHEFLTSVLDALSTDMVHAASDPSSSSGRLSEPDPSHTLEER 350

351 VVHWYFKLLDKNSSGDIGKKEIKPFKRFLRKKSKPKKCVKKFVEYCDVNN 400
    ||||||||||||||||||||||||||||||||||||||||||||||||||
351 VVHWYFKLLDKNSSGDIGKKEIKPFKRFLRKKSKPKKCVKKFVEYCDVNN 400

401 DKSISVQELMGCLGVAKEDGKADTKKRHTPRGHAESTSNRQ          441
    ||||||||||||||||||||||||||||||||||||||||
401 DKSISVQELMGCLGVAKEDGKADTKKRHTPRGHAESTSNRQ          441
```

Sequence name: /tmp/QSUNfTsJ5y/kLOw5Vb6SD: SMO2_HUMAN

Sequence documentation:

Alignment of: Z44808_PEA_1_P6 (SEQ ID NO: 635) x SMO2_HUMAN . . .

Alignment segment 1/1:
  Quality: 4310.00

Escore: 0
  Matching length: 428 Total length: 428

Matching Percent Similarity: 100.00 Matching Percent Identity: 100.00
  Total Percent Similarity: 100.00 Total Percent Identity: 100.00
  Gaps: 0

Alignment:

Sequence name: /tmp/MZVdR4PVdM/5uN8RwViJ1: SMO2_HUMAN

Sequence documentation:

Alignment of: Z44808_PEA_1_P7 (SEQ ID NO: 636) x SMO2 HUMAN . . .

Alignment segment 1/1:
  Quality: 4440.00

Escore: 0
  Matching length: 441 Total length: 441

Matching Percent Similarity: 100.00 Matching Percent Identity: 100.00
  Total Percent Similarity: 100.00 Total Percent Identity: 100.00
  Gaps: 0

```
  1 MLLPQLCWLPLLAGLLPPVPAQKFSALTFLRVDQDKDKDCSLDCAGSPQK  50
    ||||||||||||||||||||||||||||||||||||||||||||||||||
  1 MLLPQLCWLPLLAGLLPPVPAQKFSALTFLRVDQDKDKDCSLDCAGSPQK  50

51 PLCASDGRTFLSRCEFQRAKCKDPQLEIAYRGNCKDVSRCVAERKYTQEQ 100
    ||||||||||||||||||||||||||||||||||||||||||||||||||
 51 PLCASDGRTFLSRCEFQRAKCKDPQLEIAYRGNCKDVSRCVAERKYTQEQ 100

101 ARKEFQQVFIPECNDDGTYSQVQCHSYTGYCWCVTPNGRPISGTAVAHKT 150
    ||||||||||||||||||||||||||||||||||||||||||||||||||
101 ARKEFQQVFIPECNDDGTYSQVQCHSYTGYCWCVTPNGRPISGTAVAHKT 150

151 PRCPGSVNEKLPQREGTGKTDDAAAPALETQPQGDEEDIASRYPTLWTEQ 200
    ||||||||||||||||||||||||||||||||||||||||||||||||||
151 PRCPGSVNEKLPQREGTGKTDDAAAPALETQPQGDEEDIASRYPTLWTEQ 200

201 VKSRQNKTNKNSVSSCDQEHQSALEEAKQPKNDNVVIPECAHGGLYKPVQ 250
    ||||||||||||||||||||||||||||||||||||||||||||||||||
201 VKSRQNKTNKNSVSSCDQEHQSALEEAKQPKNDNVVIPECAHGGLYKPVQ 250

251 CHPSTGYCWCVLVDTGRPIPGTSTRYEQPKCDNTARAHPAKARDLYKGRQ 300
    ||||||||||||||||||||||||||||||||||||||||||||||||||
251 CHPSTGYCWCVLVDTGRPIPGTSTRYEQPKCDNTARAHPAKARDLYKGRQ 300

301 LQGCPGAKKHEFLTSVLDALSTDMVHAASDPSSSSGRLSEPDPSHTLEER 350
    ||||||||||||||||||||||||||||||||||||||||||||||||||
301 LQGCPGAKKHEFLTSVLDALSTDMVHAASDPSSSSGRLSEPDPSHTLEER 350

351 VVHWYFKLLDKNSSGDIGKKEIKPFKRFLRKKSKPKKCVKKFVEYCDVNN 400
    ||||||||||||||||||||||||||||||||||||||||||||||||||
351 VVHWYFKLLDKNSSGDIGKKEIKPFKRFLRKKSKPKKCVKKFVEYCDVNN 400

401 DKSISVQELMGCLGVAKEDGKADTKKRH                       428
    ||||||||||||||||||||||||||||
401 DKSISVQELMGCLGVAKEDGKADTKKRH                       428
```

Alignment:

```
  1  MLLPQLCWLPLLAGLLPPVPAQKFSALTFLRVDQDKDKDCSLDCAGSPQK   50
     ||||||||||||||||||||||||||||||||||||||||||||||||||
  1  MLLPQLCWLPLLAGLLPPVPAQKFSALTFLRVDQDKDKDCSLDCAGSPQK   50

51  PLCASDGRTFLSRCEFQRAKCKDPQLEIAYRGNCKDVSRCVAERKYTQEQ  100
     ||||||||||||||||||||||||||||||||||||||||||||||||||
 51  PLCASDGRTFLSRCEFQRAKCKDPQLEIAYRGNCKDVSRCVAERKYTQEQ  100

101  ARKEFQQVFIPECNDDGTYSQVQCHSYTGYCWCVTPNGRPISGTAVAHKT  150
     ||||||||||||||||||||||||||||||||||||||||||||||||||
101  ARKEFQQVFIPECNDDGTYSQVQCHSYTGYCWCVTPNGRPISGTAVAHKT  150

151  PRCPGSVNEKLPQREGTGKTDDAAAPALETQPQGDEEDIASRYPTLWTEQ  200
     ||||||||||||||||||||||||||||||||||||||||||||||||||
151  PRCPGSVNEKLPQREGTGKTDDAAAPALETQPQGDEEDIASRYPTLWTEQ  200

201  VKSRQNKTNKNSVSSCDQEHQSALEEAKQPKNDNVVIPECAHGGLYKPVQ  250
     ||||||||||||||||||||||||||||||||||||||||||||||||||
201  VKSRQNKTNKNSVSSCDQEHQSALEEAKQPKNDNVVIPECAHGGLYKPVQ  250

251  CHPSTGYCWCVLVDTGRPIPGTSTRYEQPKCDNTARAHPAKARDLYKGRQ  300
     ||||||||||||||||||||||||||||||||||||||||||||||||||
251  CHPSTGYCWCVLVDTGRPIPGTSTRYEQPKCDNTARAHPAKARDLYKGRQ  300

301  LQGCPGAKKHEFLTSVLDALSTDMVHAASDPSSSSGRLSEPDPSHTLEER  350
     ||||||||||||||||||||||||||||||||||||||||||||||||||
301  LQGCPGAKKHEFLTSVLDALSTDMVHAASDPSSSSGRLSEPDPSHTLEER  350

351  VVHWYFKLLDKNSSGDIGKKEIKPFKRFLRKKSKPKKCVKKFVEYCDVNN  400
     ||||||||||||||||||||||||||||||||||||||||||||||||||
351  VVHWYFKLLDKNSSGDIGKKEIKPFKRFLRKKSKPKKCVKKFVEYCDVNN  400

401  DKSISVQELMGCLGVAKEDGKADTKKRHTPRGHAESTSNRQ           441
     |||||||||||||||||||||||||||||||||||||||||
401  DKSISVQELMGCLGVAKEDGKADTKKRHTPRGHAESTSNRQ           441
```

Sequence name: /tmp/3fGVxqLloe/J5mQduAd0F: SMO2_HUMAN

Sequence documentation:

Alignment of: Z44808_PEA_1_P11 (SEQ ID NO: 637) x SMO2_HUMAN...

Alignment segment 1/1:
 Quality: 4228.00

Escore: 0
 Matching length: 429 Total length: 446

Matching Percent Similarity: 100.00 Matching Percent Identity: 100.00
 Total Percent Similarity: 96.19 Total Percent Identity: 96.19
 Gaps: 1

Alignment:

```
  1  MLLPQLCWLPLLAGLLPPVPAQKFSALTFLRVDQDKDKDCSLDCAGSPQK   50
     ||||||||||||||||||||||||||||||||||||||||||||||||||
  1  MLLPQLCWLPLLAGLLPPVPAQKFSALTFLRVDQDKDKDCSLDCAGSPQK   50

51  PLCASDGRTFLSRCEFQRAKCKDPQLEIAYRGNCKDVSRCVAERKYTQEQ  100
     ||||||||||||||||||||||||||||||||||||||||||||||||||
 51  PLCASDGRTFLSRCEFQRAKCKDPQLEIAYRGNCKDVSRCVAERKYTQEQ  100

101  ARKEFQQVFIPECNDDGTYSQVQCHSYTGYCWCVTPNGRPISGTAVAHKT  150
     ||||||||||||||||||||||||||||||||||||||||||||||||||
101  ARKEFQQVFIPECNDDGTYSQVQCHSYTGYCWCVTPNGRPISGTAVAHKT  150

151  PRCPGSVNEKLPQREGTGKT.................DIASRYPTLWTEQ  183
     ||||||||||||||||||||                 |||||||||||||
151  PRCPGSVNEKLPQREGTGKTDDAAAPALETQPQGDEEDIASRYPTLWTEQ  200

184  VKSRQNKTNKNSVSSCDQEHQSALEEAKQPKNDNVVIPECAHGGLYKPVQ  233
     ||||||||||||||||||||||||||||||||||||||||||||||||||
201  VKSRQNKTNKNSVSSCDQEHQSALEEAKQPKNDNVVIPECAHGGLYKPVQ  250
```

```
234  CHPSTGYCWCVLVDTGRPIPGTSTRYEQPKCDNTARAHPAKARDLYKGRQ  283
     |||||||||||||||||||||||||||||||||||||||||||||||||
251  CHPSTGYCWCVLVDTGRPIPGTSTRYEQPKCDNTARAHPAKARDLYKGRQ  300

284  LQGCPGAKKHEFLTSVLDALSTDMVHAASDPSSSSGRLSEPDPSHTLEER  333
     |||||||||||||||||||||||||||||||||||||||||||||||||
301  LQGCPGAKKHEFLTSVLDALSTDMVHAASDPSSSSGRLSEPDPSHTLEER  350

334  VVHWYFKLLDKNSSGDIGKKEIKPFKRFLRKKSKPKKCVKKFVEYCDVNN  383
     |||||||||||||||||||||||||||||||||||||||||||||||||
351  VVHWYFKLLDKNSSGDIGKKEIKPFKRFLRKKSKPKKCVKKFVEYCDVNN  400

384  DKSISVQELMGCLGVAKEDGKADTKKRHTPRGHAESTSNRQPRKQG      429
     ||||||||||||||||||||||||||||||||||||||||||||||
401  DKSISVQELMGCLGVAKEDGKADTKKRHTPRGHAESTSNRQPRKQG      446
```

Expression of SMO2_HUMAN SPARC Related Modular Calcium-Binding Protein 2 Precursor (Secreted Modular Calcium-Binding Protein 2) (SMOC-2) (Smooth Muscle-Associated Protein 2) Z44808 Transcripts, which are Detectable by Amplicon as Depicted in Sequence Name Z44808 junc8-11 (SEQ ID NO: 1006) in Normal and Cancerous Ovary Tissues Expression of SMO2_HUMAN SPARC related modular calcium-binding protein 2 precursor (Secreted modular calcium-binding protein 2) (SMOC-2) (Smooth muscle-associated protein 2) transcripts detectable by or according to junc8-11, Z44808 junc8-11 (SEQ ID NO: 1006) amplicon(s) and Z44808 junc8-11F (SEQ ID NO: 1004) and Z44808 junc8-11R (SEQ ID NO:1005) primers was measured by real time PCR. In parallel the expression of four housekeeping genes —PBGD (GenBank Accession No. BC019323 (SEQ ID NO:1036); amplicon—PBGD-amplicon (SEQ ID NO:1039)), HPRT1 (GenBank Accession No. NM_000194 (SEQ ID NO: 1040); amplicon—HPRT1-amplicon (SEQ ID NO: 1044)), SDHA (GenBank Accession No. NM_004168 (SEQ ID NO: 1032); amplicon—SDHA-amplicon (SEQ ID NO:1035)), and GAPDH (GenBank Accession No. BC026907; GAPDH amplicon (SEQ ID NO: 1047)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45-48, 71, Table 1, "Tissue sample in testing panel", above). The reciprocal of this ratio was then calculated, to obtain a value of fold down-regulation for each sample relative to median of the normal PM samples.

Figure 33A:
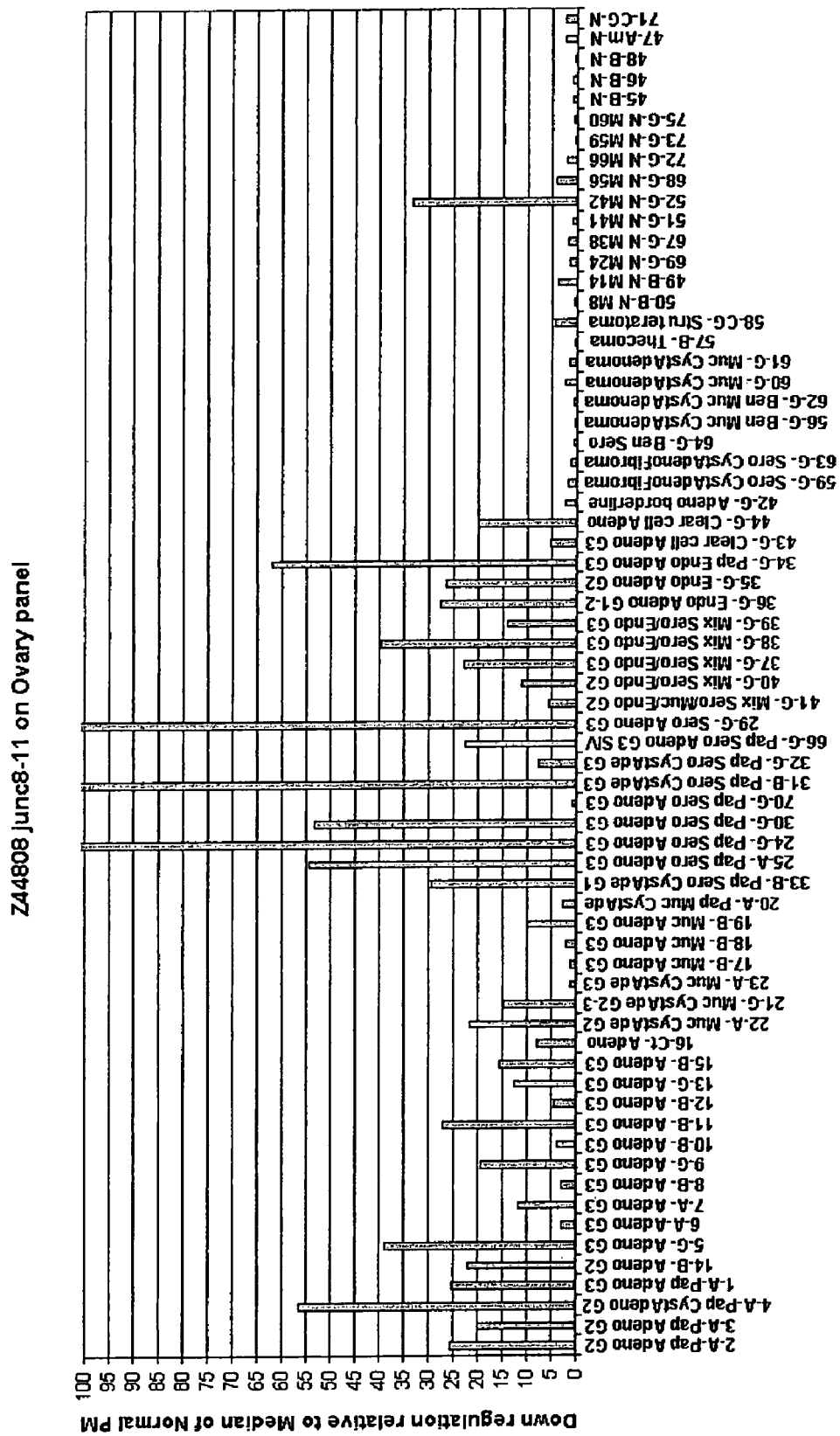
FIGS. 33A and 33B are histograms showing down regulation of Z44808 junc8-11 (SEQ ID NO: 1006) transcripts in cancerous ovary samples relative to the normal samples (33A) or expression in normal tissues (33B).

FIG. 33A is a histogram showing down regulation of the above-indicated SMO2_HUMAN SPARC related modular calcium-binding protein 2 precursor transcripts in cancerous ovary samples relative to the normal samples.

As is evident from FIG. 33A, the expression of SMO2_HUMAN SPARC related modular calcium-binding protein 2 precursor transcripts detectable by the above amplicon(s) in cancer samples was significantly lower than in the non-cancerous samples (Sample Nos. 45-48, 71, Table 1, "Tissue sample in testing panel"). Notably down regulation of at least 5 fold was found in 33 out of 43 adenocarcinoma samples.

Statistical analysis was applied to verify the significance of these results, as described below.

The P value for the difference in the expression levels of SMO2_HUMAN SPARC related modular calcium-binding protein 2 precursor transcripts detectable by the above amplicon(s) in ovary cancer samples versus the normal tissue samples was determined by T test as 4.47E-05. Threshold of 5 fold down regulation was found to differentiate between cancer and normal samples with P value of 1.75E-03 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: Z44808 junc8-1° F. (SEQ ID NO:10046) forward primer; and Z44808 junc8-11R (SEQ ID NO:1005) reverse primer.

The present invention also preferably encompasses any amplicon obtained through the use of any suitable primer pair; for example, for the above experiment, the following amplicon was obtained as a non-limiting illustrative example only of a suitable amplicon: Z44808 junc8-11 (SEQ ID NO: 1006).

Z44808 junc8-11 Forward primer (SEQ ID NO: 1004): GAAGGCACAGGAAAAACAGATATTG

Z44808 junc8-11 Reverse primer (SEQ ID NO: 1005): TGGTGCTCTTGGTCACAGGAT

Figure 33B:
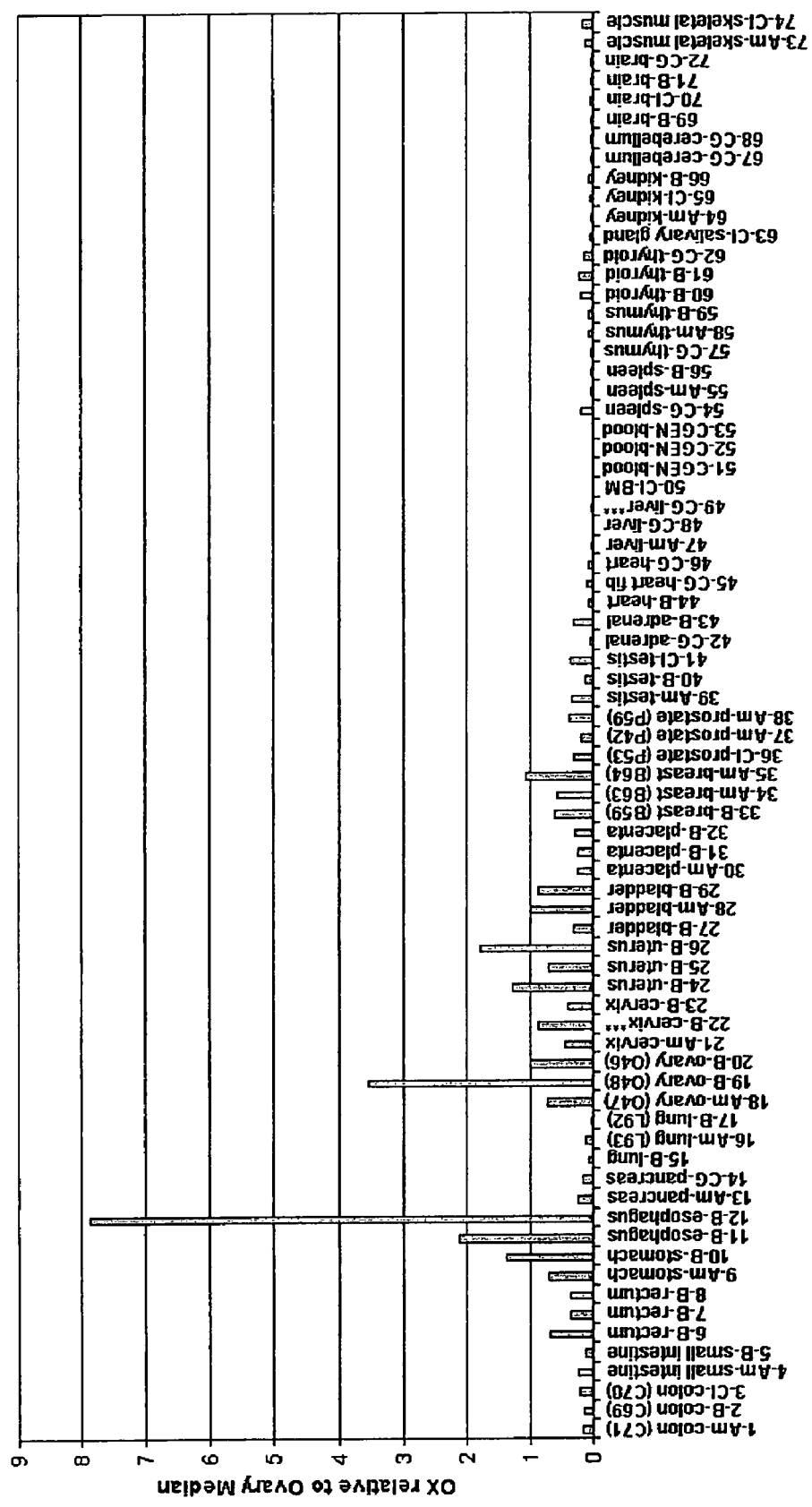

Z44808 junc8-11 Amplicon (SEQ ID NO: 1006): GAAGGCACAGGAAAAACAGATATTGCATCACGTTACCCTACCCTTTGGACTGAACA GGTTAAAAGTCGGCAGAACAAAACCAATAAGAATTCAG TGTCATCCTGTGACCAAG AGCACCA Expression of SMO2_HUMAN SPARC Related Modular Calcium-Binding Protein 2 Precursor (Secreted Modular Calcium-Binding Protein 2) (SMOC-2) (Smooth Muscle-Associated Protein 2) Z44808 Transcripts which are Detectable by Amplicon as Depicted in Sequence Name Z44808 junc8-11 (SEQ ID NO:1006) in Different Normal Tissues Expression of SMO2_HUMAN SPARC related modular calcium-binding protein 2 precursor (Secreted modular calcium-binding protein 2) (SMOC-2) (Smooth muscle-associated protein 2) transcripts detectable by or according to Z44808 junc8-11 (SEQ ID NO: 1006) amplicon(s) and primers: Z44808 junc8-11F (SEQ ID NO: 1004) Z44808 junc8-11R (SEQ ID NO: 1005) was measured by real time PCR. In parallel the expression of four housekeeping genes—RPL19 (GenBank Accession No. NM_000981 (SEQ ID NO:1048); RPL19 amplicon (SEQ ID NO: 1051)), TATA box (GenBank Accession No. NM_003194 (SEQ ID NO: 1052); TATA amplicon (SEQ ID NO:1055)), Ubiquitin (GenBank Accession No. BC000449 (SEQ ID NO:1056); amplicon—Ubiquitin-amplicon (SEQ ID NO:1059)) and SDHA (GenBank Accession No. NM_004168 (SEQ ID NO: 1032); amplicon—SDHA-amplicon (SEQ ID NO:1035)) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 2: Tissue samples in normal panel, above), to obtain a value of relative expression of each sample relative to median of the ovary samples. Results are shown in FIG. 33B. Primers and amplicon are as above.

DESCRIPTION FOR CLUSTER S67314

Cluster S67314 features 4 transcript(s) and 8 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| S67314_PEA_1_T4 | 638 |
| S67314_PEA_1_T5 | 639 |
| S67314_PEA_1_T6 | 640 |
| S67314_PEA_1_T7 | 641 |

TABLE 2

Segments of interest

| Segment Name | SEQ ID NO: |
|---|---|
| S67314_PEA_1_node_0 | 642 |
| S67314_PEA_1_node_11 | 643 |
| S67314_PEA_1_node_13 | 644 |
| S67314_PEA_1_node_15 | 645 |
| S67314_PEA_1_node_17 | 646 |
| S67314_PEA_1_node_4 | 647 |
| S67314_PEA_1_node_10 | 648 |
| S67314_PEA_1_node_3 | 649 |

TABLE 3

Proteins of interest

| Protein Name | SEQ ID NO: |
|---|---|
| S67314_PEA_1_P4 | 651 |
| S67314_PEA_1_P5 | 652 |
| S67314_PEA_1_P6 | 653 |
| S67314_PEA_1_P7 | 654 |

These sequences are variants of the known protein Fatty acid-binding protein, heart (SwissProt accession identifier FABH_HUMAN; known also according to the synonyms H-FABP; Muscle fatty acid-binding protein; M-FABP; Mammary-derived growth inhibitor; MDGI), SEQ ID NO: 650, referred to herein as the previously known protein.

Protein Fatty acid-binding protein is known or believed to have the following function(s): FABP are thought to play a role in the intracellular transport of long-chain fatty acids and their acyl-CoA esters. The sequence for protein Fatty acid-binding protein is given at the end of the application, as "Fatty acid-binding protein, heart amino acid sequence". Known polymorphisms for this sequence are as shown in Table 4.

TABLE 4

Amino acid mutations for Known Protein

| SNP position(s) on amino acid sequence | Comment |
|---|---|
| 1 | V -> A |
| 104 | L -> K |
| 124 | C -> S |
| 129 | E -> Q |

Protein Fatty acid-binding protein localization is believed to be cytoplasmic.

The following GO Annotation(s) apply to the previously known protein. The following annotation(s) were found: negative control of cell proliferation, which are annotation(s) related to Biological Process; and lipid binding, which are annotation(s) related to Molecular Function.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

As noted above, cluster S67314 features 4 transcript(s), which were listed in Table 1 above. These transcript(s) encode for protein(s) which are variant(s) of protein Fatty acid-binding protein. A description of each variant protein according to the present invention is now provided.

Variant protein S67314_PEA_1_P4 (SEQ ID NO: 651) according to the present invention has an amino acid sequence as given at the end of the application; it is encoded by transcript(s) S67314_PEA_1_T4 (SEQ ID NO: 638). An alignment is given to the known protein (Fatty acid-binding protein) at the end of the application. One or more alignments to one or more previously published protein sequences are given at the end of the application. A brief description of the relationship of the variant protein according to the present invention to each such aligned protein is as follows:

Comparison report between S67314_PEA_1_P4 (SEQ ID NO: 651) and FABH_HUMAN:

1. An isolated chimeric polypeptide encoding for S67314_PEA_1_P4 (SEQ ID NO: 651), comprising a first amino acid sequence being at least 70%, optionally at least 80%, preferably at least 85%, more preferably at least 90% and most preferably at least 95% homologous to a polypeptide having the sequence MVDAFLGTWKLVDSKNFDDYMKSLGVGFATRQVASMTKPTTIIEKNGDILTLKTHSTF KNTEISFKLGVEFDETTADDRKVK-SIVTLDGGKLVHLQKWDGQETTLVRELIDGKLIL corresponding to amino acids 1-116 of FABH_HUMAN, which also corresponds to amino acids 1-116 of S67314_PEA_1_P4 (SEQ ID NO: 651), and a second amino acid sequence being at least 70%, optionally at least 80%, preferably at least 85%, more preferably at least 90% and most preferably at least 95% homologous to a polypeptide having the sequence VRWATLELYLIGYYYCSFSQACSKKPSPPLRAVEAGTREWLWVRVVSGGNFLCSGFGL TQAGT-QILPYRLHDCGQITFSKCNCKTGINNTNLVGLLGSL (SEQ ID NO: 1080) corresponding to amino acids 117-215 of S67314_PEA_1_P4 (SEQ ID NO: 651), wherein said first and second amino acid sequences are contiguous and in a sequential order.

2. An isolated polypeptide encoding for a tail of S67314_PEA_1_P4 (SEQ ID NO: 651), comprising a polypeptide being at least 70%, optionally at least about 80%, preferably at least about 85%, more preferably at least about 90% and most preferably at least about 95% homologous to the sequence VRWATLELYLIGYYYCSFSQACSKKPSPPLRAVEAGTREWLWVRVVSGGNFLCSGFGL TQAGTQILPYRLHDCGQITFSKCNCKTGINNTNLVGLLGSL (SEQ ID NO: 1080) in S67314_PEA_1_P4 (SEQ ID NO: 651).

Comparison report between S67314_PEA_1_P4 (SEQ ID NO: 651) and AAP35373 (SEQ ID NO: 1007):

1. An isolated chimeric polypeptide encoding for S67314_PEA_1_P4 (SEQ ID NO: 651), comprising a first amino acid sequence being at least 90% homologous to MVDAFLGTWKLVDSKNFDDYMKSLGVGFATRQVASMTKPTTIIEKNGDILTLKTHSTF KNTEISFKLGVEFDETTADDRKVKSIVTLDGGKLVHLQKWDGQETTLVRELIDGKLIL corresponding to amino acids 1-116 of AAP35373, which also corresponds to amino acids 1-116 of S67314_PEA_1_P4 (SEQ ID NO: 651), and a second amino acid sequence being at least 70%, optionally at least 80%, preferably at least 85%, more preferably at least 90% and most preferably at least 95% homologous to a polypeptide having the sequence VRWATLELYLIGYYYCSFSQACSKKPSPPLRAVEAGTREWLWVRVVS GGNFLCSGFGL TQAGTQILPYRLHDCGQITFSKCNCKTGINNTNLVGLLGSL (SEQ ID NO: 1080) corresponding to amino acids 117-215 of S67314_PEA_1_P4 (SEQ ID NO: 651), wherein said first and second amino acid sequences are contiguous and in a sequential order.

2. An isolated polypeptide encoding for a tail of S67314_PEA_1_P4 (SEQ ID NO: 651), comprising a polypeptide being at least 70%, optionally at least about 80%, preferably at least about 85%, more preferably at least about 90% and most preferably at least about 95% homologous to the sequence VRWATLELYLIGYYYCSFSQACSKKPSPPLRAVEAGTREWLWVRVVSGGNFLCSGFGL TQAGTQILPYRLHDCGQITFSKCNCKTGINNTNLVGLLGSL (SEQ ID NO: 1080) in S67314_PEA_1_P4 (SEQ ID NO: 651).

The location of the variant protein was determined according to results from a number of different software programs and analyses, including analyses from SignalP and other specialized programs. The variant protein is believed to be located as follows with regard to the cell: intracellularly. The protein localization is believed to be intracellular because neither of the trans-membrane region prediction programs predicted a trans-membrane region for this protein. In addition both signal-peptide prediction programs predict that this protein is a non-secreted protein.

Variant protein S67314_PEA_1_P4 (SEQ ID NO: 651) also has the following non-silent SNPs (Single Nucleotide Polymorphisms) as listed in Table 5, (given according to their position(s) on the amino acid sequence, with the alternative amino acid(s) listed; the last column indicates whether the SNP is known or not; the presence of known SNPs in variant protein S67314_PEA_1_P4 (SEQ ID NO: 651) sequence provides support for the deduced sequence of this variant protein according to the present invention).

TABLE 5

Amino acid mutations

| SNP position(s) on amino acid sequence | Alternative amino acid(s) | Previously known SNP? |
|---|---|---|
| 53 | K -> R | Yes |

Variant protein S67314_PEA_1_P4 (SEQ ID NO: 651) is encoded by the following transcript(s): S67314_PEA_1_T4 (SEQ ID NO: 638), for which the sequence(s) is/are given at the end of the application. The coding portion of transcript S67314_PEA_1_T4 (SEQ ID NO: 638) is shown in bold; this coding portion starts at position 925 and ends at position 1569. The transcript also has the following SNPs as listed in Table 6 (given according to their position on the nucleotide sequence, with the alternative nucleic acid listed; the last column indicates whether the SNP is known or not; the presence of known SNPs in variant protein S67314_PEA_1_P4 (SEQ ID NO: 651) sequence provides support for the deduced sequence of this variant protein according to the present invention).

TABLE 6

Nucleic acid SNPs

| SNP position on nucleotide sequence | Alternative nucleic acid | Previously known SNP? |
|---|---|---|
| 580 | T -> C | Yes |
| 1082 | A -> G | Yes |
| 1670 | A -> C | Yes |

Variant protein S67314_PEA_1_P5 (SEQ ID NO: 652) according to the present invention has an amino acid sequence as given at the end of the application; it is encoded by transcript(s) S67314_PEA_1_T5 (SEQ ID NO: 639). An alignment is given to the known protein (Fatty acid-binding protein, heart) at the end of the application. One or more alignments to one or more previously published protein sequences are given at the end of the application. A brief description of the relationship of the variant protein according to the present invention to each such aligned protein is as follows:

Comparison report between S67314_PEA_1_P5 (SEQ ID NO: 652) and FABH_HUMAN:

1. An isolated chimeric polypeptide encoding for S67314_PEA_1_P5 (SEQ ID NO: 652), comprising a first amino acid sequence being at least 70%, optionally at least 80%, preferably at least 85%, more preferably at least 90% and most preferably at least 95% homologous to a polypeptide having the sequence MVDAFLGTWKLVDSKNFDDYMKSLGVGFATRQVASMTKPTTIIEKNGDILTLKTHSTF KNTEISFKLGVEFDETTADDRKVKSIVTLDGGKLVHLQKWDGQETTLVRELIDGKLIL corresponding to amino acids 1-116 of FABH_HUMAN, which also corresponds to amino acids 1-116 of S67314_PEA_1_P5 (SEQ ID NO: 652), and a second amino acid sequence being at least 70%, optionally at least 80%, preferably at least 85%, more preferably at least 90% and most preferably at least 95% homologous to a polypeptide having the sequence DVLTAWPSIYRRQVKVLREDEITILPWHLQWSREKATKLLRPTLPSYNNHGWEELRVG KSIV (SEQ ID NO: 1081) corresponding to amino acids 117-178 of S67314_PEA_1_P5 (SEQ ID NO: 652), wherein said first and second amino acid sequences are contiguous and in a sequential order.

2. An isolated polypeptide encoding for a tail of S67314_PEA_1_P5 (SEQ ID NO: 652), comprising a polypeptide being at least 70%, optionally at least about 80%, preferably at least about 85%, more preferably at least about 90% and most preferably at least about 95% homologous to the sequence DVLTAWPSIYRRQVKVLREDEITILP- WHLQWSREKATKLLRPTLPSYNNHGWEELRVG KSIV (SEQ ID NO: 1081) in S67314_PEA_1_P5 (SEQ ID NO: 652).

Comparison report between S67314_PEA_1_P5 (SEQ ID NO: 652) and AAP35373:

1. An isolated chimeric polypeptide encoding for S67314_PEA_1_P5 (SEQ ID NO: 652), comprising a first amino acid sequence being at least 90% homologous to MVDAFLGTWKLVDSKNFDDYMKSLGVG-FATRQVASMTKPTTIIEKNGDILTLKTHSTF KNTEIS-FKLGVEFDETTADDRKVKSIVTLDG-GKLVHLQKWDGQETTLVRELIDGKLIL corresponding to amino acids 1-116 of AAP35373, which also corresponds to amino acids 1-116 of S67314_PEA_1_P5 (SEQ ID NO: 652), and a second amino acid sequence being at least 70%, optionally at least 80%, preferably at least 85%, more preferably at least 90% and most preferably at least 95% homologous to a polypeptide having the sequence DVLTAWPSIYR-RQVKVLREDEITILPWHLQWSREKATKLLRPTLPSYN NHGWEELRVG KSIV (SEQ ID NO: 1081) corresponding to amino acids 117-178 of S67314_PEA_1_P5 (SEQ ID NO: 652), wherein said first and second amino acid sequences are contiguous and in a sequential order.

2. An isolated polypeptide encoding for a tail of S67314_PEA_1_P5 (SEQ ID NO: 652), comprising a polypeptide being at least 70%, optionally at least about 80%, preferably at least about 85%, more preferably at least about 90% and most preferably at least about 95% homologous to the sequence DVLTAWPSIYRRQVKVLREDEITILP-WHLQWSREKATKLLRPTLPSYNNHGWEELRVG KSIV (SEQ ID NO: 1081) in S67314_PEA_1_P5 (SEQ ID NO: 652).

The location of the variant protein was determined according to results from a number of different software programs and analyses, including analyses from SignalP and other specialized programs. The variant protein is believed to be located as follows with regard to the cell: intracellularly. The protein localization is believed to be intracellular because neither of the trans-membrane region prediction programs predicted a trans-membrane region for this protein. In addition both signal-peptide prediction programs predict that this protein is a non-secreted protein.

Variant protein S67314_PEA_1_P5 (SEQ ID NO: 652) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein S67314_PEA_1_P5 (SEQ ID NO: 652) sequence provides support for the deduced sequence of this variant protein according to the present invention).

TABLE 7

Amino acid mutations

| SNP position(s) on amino acid sequence | Alternative amino acid(s) | Previously known SNP? |
|---|---|---|
| 53 | K -> R | Yes |

Variant protein S67314_PEA_1_P5 (SEQ ID NO: 652) is encoded by the following transcript(s): S67314_PEA_1_T5 (SEQ ID NO: 639), for which the sequence(s) is/are given at the end of the application. The coding portion of transcript S67314_PEA_1_T5 (SEQ ID NO: 639) is shown in bold; this coding portion starts at position 925 and ends at position 1458. The transcript also has the following SNPs as listed in Table 8 (given according to their position on the nucleotide sequence, with the alternative nucleic acid listed; the last column indicates whether the SNP is known or not; the presence of known SNPs in variant protein S67314_PEA_1_P5 (SEQ ID NO: 652) sequence provides support for the deduced sequence of this variant protein according to the present invention).

TABLE 8

Nucleic acid SNPs

| SNP position on nucleotide sequence | Alternative nucleic acid | Previously known SNP? |
|---|---|---|
| 580 | T -> C | Yes |
| 1082 | A -> G | Yes |
| 1326 | A -> G | Yes |

Variant protein S67314_PEA_1_P6 (SEQ ID NO: 653) according to the present invention has an amino acid sequence as given at the end of the application; it is encoded by transcript(s) S67314_PEA_1_T6 (SEQ ID NO: 640). An alignment is given to the known protein (Fatty acid-binding protein, heart) at the end of the application. One or more alignments to one or more previously published protein sequences are given at the end of the application. A brief description of the relationship of the variant protein according to the present invention to each such aligned protein is as follows:

Comparison report between S67314_PEA_1_P6 (SEQ ID NO: 653) and FABH_HUMAN:

1. An isolated chimeric polypeptide encoding for S67314_PEA_1_P6 (SEQ ID NO: 653), comprising a first amino acid sequence being at least 70%, optionally at least 80%, preferably at least 85%, more preferably at least 90% and most preferably at least 95% homologous to a polypeptide having the sequence MVDAFLGTWKLVDSKNFD-DYMKSLGVGFATRQVASMTKPTTI-IEKNGDILTLKTHSTF KNTEISFKLGVEFDETTADDRKVK-SIVTLDGGKLVHLQKWDGQETTLVRELIDGKLIL corresponding to amino acids 1-116 of FABH_HUMAN, which also corresponds to amino acids 1-116 of S67314_PEA_1_P6 (SEQ ID NO: 653), and a second amino acid sequence being at least 70%, optionally at least 80%, preferably at least 85%, more preferably at least 90% and most preferably at least 95% homologous to a polypeptide having the sequence MEKLQLRNVK (SEQ ID NO: 1082) corresponding to amino acids 117-126 of S67314_PEA_1_P6 (SEQ ID NO: 653), wherein said first and second amino acid sequences are contiguous and in a sequential order.

2. An isolated polypeptide encoding for a tail of S67314_PEA_1_P6 (SEQ ID NO: 653), comprising a polypeptide being at least 70%, optionally at least about 80%, preferably at least about 85%, more preferably at least about 90% and most preferably at least about 95% homologous to the sequence MEKLQLRNVK (SEQ ID NO: 1082) in S67314_PEA_1_P6 (SEQ ID NO: 653).

Comparison report between S67314_PEA_1_P6 (SEQ ID NO: 653) and AAP35373:

1. An isolated chimeric polypeptide encoding for S67314_PEA_1_P6 (SEQ ID NO: 653), comprising a first amino acid sequence being at least 90% homologous to MVDAFLGTWKLVDSKNFDDYMKSLGVG-FATRQVASMTKPTTIIEKNGDILTLKTHSTF KNTEIS-FKLGVEFDETTADDRKVKSIVTLDG-GKLVHLQKWDGQETTLVRELIDGKLIL corresponding to amino acids 1-116 of AAP35373, which also corresponds to amino acids 1-116 of S67314_PEA_1_P6 (SEQ ID NO: 653), and a second amino acid sequence being at least 70%, optionally at least 80%, preferably at least 85%, more preferably at least 90% and most preferably at least 95% homologous to a polypeptide having the sequence MEKLQLRNVK (SEQ ID NO: 1082) corresponding to amino acids 117-126 of S67314_PEA_1_P6 (SEQ ID NO: 653), wherein said first and second amino acid sequences are contiguous and in a sequential order.

2. An isolated polypeptide encoding for a tail of S67314_PEA_1_P6 (SEQ ID NO: 653), comprising a polypeptide being at least 70%, optionally at least about 80%, preferably at least about 85%, more preferably at least about 90% and most preferably at least about 95% homologous to the sequence MEKLQLRNVK (SEQ ID NO: 1082) in S67314_PEA_1_P6 (SEQ ID NO: 653).

The location of the variant protein was determined according to results from a number of different software programs and analyses, including analyses from SignalP and other specialized programs. The variant protein is believed to be located as follows with regard to the cell: intracellularly. The protein localization is believed to be intracellular because neither of the trans-membrane region prediction programs predicted a trans-membrane region for this protein. In addition both signal-peptide prediction programs predict that this protein is a non-secreted protein.

Variant protein S67314_PEA_1_P6 (SEQ ID NO: 653) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein S67314_PEA_1_P6 (SEQ ID NO: 653) sequence provides support for the deduced sequence of this variant protein according to the present invention).

TABLE 9

Amino acid mutations

| SNP position(s) on amino acid sequence | Alternative amino acid(s) | Previously known SNP? |
|---|---|---|
| 53 | K –> R | Yes |

Variant protein S67314_PEA_1_P6 (SEQ ID NO: 653) is encoded by the following transcript(s): S67314_PEA_1_T6 (SEQ ID NO: 640), for which the sequence(s) is/are given at the end of the application. The coding portion of transcript S67314_PEA_1_T6 (SEQ ID NO: 640) is shown in bold; this coding portion starts at position 925 and ends at position 1302. The transcript also has the following SNPs as listed in Table 10 (given according to their position on the nucleotide sequence, with the alternative nucleic acid listed; the last column indicates whether the SNP is known or not; the presence of known SNPs in variant protein S67314_PEA_1_P6 (SEQ ID NO: 653) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 580 | T –> C | Yes |
| 1082 | A –> G | Yes |
| 1444 | T –> C | Yes |

Variant protein S67314_PEA_1_P7 (SEQ ID NO: 654) according to the present invention has an amino acid sequence as given at the end of the application; it is encoded by transcript(s) S67314_PEA_1_T7 (SEQ ID NO: 641. An alignment is given to the known protein (Fatty acid-binding protein) at the end of the application. One or more alignments to one or more previously published protein sequences are given at the end of the application. A brief description of the relationship of the variant protein according to the present invention to each such aligned protein is as follows:

Comparison report between S67314_PEA_1_P7 (SEQ ID NO: 654) and FABH_HUMAN:

1. An isolated chimeric polypeptide encoding for S67314_PEA_1_P7 (SEQ ID NO: 654), comprising a first amino acid sequence being at least 90% homologous to MVDAFLGTWKLVDSKNFDDYMKSL corresponding to amino acids 1-24 of FABH_HUMAN, which also corresponds to amino acids 1-24 of S67314_PEA_1_P7 (SEQ ID NO: 654), second amino acid sequence being at least 70%, optionally at least 80%, preferably at least 85%, more preferably at least 90% and most preferably at least 95% homologous to a polypeptide having the sequence AHILITFPLPS (SEQ ID NO: 1143) corresponding to amino acids 25-35 of S67314_PEA_1_P7 (SEQ ID NO: 654), and a third amino acid sequence being at least 90% homologous to GVG-FATRQVASMTKPTTIIEKNGDILTLKTH-STFKNTEISFKLGVEFDETTADDRKVKSI VTLDG-GKLVHLQKWDGQETTLVRELIDGKLILTLTHGTAVCT RTYEKEA corresponding to amino acids 25-133 of FABH-_HUMAN, which also corresponds to amino acids 36-144 of S67314_PEA_1_P7 (SEQ ID NO: 654), wherein said first, second, third and fourth amino acid sequences are contiguous and in a sequential order.

2. An isolated polypeptide encoding for an edge portion of S67314_PEA_1_P7 (SEQ ID NO: 654), comprising an amino acid sequence being at least 70%, optionally at least about 80%, preferably at least about 85%, more preferably at least about 90% and most preferably at least about 95% homologous to the sequence encoding for AHILITFPLPS (SEQ ID NO: 1143), corresponding to S67314_PEA_1_P7 (SEQ ID NO: 654).

Comparison report between S67314_PEA_1_P7 (SEQ ID NO: 654) and AAP35373:

1. An isolated chimeric polypeptide encoding for S67314_PEA_1_P7 (SEQ ID NO: 654), comprising a first amino acid sequence being at least 90% homologous to MVDAFLGTWKLVDSKNFDDYMKSL corresponding to amino acids 1-24 of AAP35373, which also corresponds to amino acids 1-24 of S67314_PEA_1_P7 (SEQ ID NO: 654), second amino acid sequence being at least 70%, optionally at least 80%, preferably at least 85%, more preferably at least 90% and most preferably at least 95% homologous to a polypeptide having the sequence AHILITFPLPS (SEQ ID NO: 1143) corresponding to amino acids 25-35 of S67314_PEA_1_P7 (SEQ ID NO: 654), and a third amino acid sequence being at least 90% homologous to GVG- FATRQVASMTKPTTIIEKNGDILTLKTH-
STFKNTEISFKLGVEFDETTADDRKVKSI VTLDG-
GKLVHLQKWDGQETTLVRELIDGKLILTLTHGTAVCT
RTYEKEA corresponding to amino acids 25-133 of
AAP35373, which also corresponds to amino acids 36-144 of
S67314_PEA_1_P7 (SEQ ID NO: 654), wherein said first,
second and third amino acid sequences are contiguous and in
a sequential order.

2. An isolated polypeptide encoding for an edge portion of
S67314_PEA_1_P7 (SEQ ID NO: 654), comprising an
amino acid sequence being at least 70%, optionally at least
about 80%, preferably at least about 85%, more preferably at
least about 90% and most preferably at least about 95%
homologous to the sequence encoding for AHILITFPLPS
(SEQ ID NO: 1143), corresponding to S67314_PEA_1_P7
(SEQ ID NO: 654).

The location of the variant protein was determined according to results from a number of different software programs and analyses, including analyses from SignalP and other specialized programs. The variant protein is believed to be located as follows with regard to the cell: intracellularly. The protein localization is believed to be intracellular because neither of the trans-membrane region prediction programs predicted a trans-membrane region for this protein. In addition both signal-peptide prediction programs predict that this protein is a non-secreted protein.

Variant protein S67314_PEA_1_P7 (SEQ ID NO: 654) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein S67314_PEA_1_P7 (SEQ ID NO: 654) sequence provides support for the deduced sequence of this variant protein according to the present invention).

TABLE 11

Amino acid mutations

| SNP position(s) on amino acid sequence | Alternative amino acid(s) | Previously known SNP? |
|---|---|---|
| 64 | K –> R | Yes |

Variant protein S67314_PEA_1_P7 (SEQ ID NO: 654) is encoded by the following transcript(s): S67314_PEA_1_T7 (SEQ ID NO: 641, for which the sequence(s) is/are given at the end of the application. The coding portion of transcript S67314_PEA_1_T7 (SEQ ID NO: 641 is shown in bold; this coding portion starts at position 925 and ends at position 1356. The transcript also has the following SNPs as listed in Table 12 (given according to their position on the nucleotide sequence, with the alternative nucleic acid listed; the last column indicates whether the SNP is known or not; the presence of known SNPs in variant protein S67314_PEA_1_P7 (SEQ ID NO: 654) sequence provides support for the deduced sequence of this variant protein according to the present invention).

TABLE 12

Nucleic acid SNPs

| SNP position on nucleotide sequence | Alternative nucleic acid | Previously known SNP? |
|---|---|---|
| 580 | T –> C | Yes |
| 1115 | A –> G | Yes |
| 2772 | G –> A | Yes |

TABLE 12-continued

Nucleic acid SNPs

| SNP position on nucleotide sequence | Alternative nucleic acid | Previously known SNP? |
|---|---|---|
| 2896 | C –> A | Yes |
| 2918 | G –> C | Yes |
| 3003 | A –> G | Yes |
| 3074 | T –> G | Yes |
| 1344 | T –> C | Yes |
| 1522 | –> T | No |
| 1540 | –> A | No |
| 1540 | –> T | No |
| 1578 | G –> A | Yes |
| 1652 | G –> A | Yes |
| 2263 | G –> A | Yes |
| 2605 | T –> C | Yes |

As noted above, cluster S67314 features 8 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster S67314_PEA_1_node_0 (SEQ ID NO: 642) according to the present invention is supported by 90 libraries. The number of libraries was determined as previously described. This segment can be found in the following transcript(s): S67314_PEA_1_T4 (SEQ ID NO: 638), S67314_PEA_1_T5 (SEQ ID NO: 639), S67314_PEA_1_T6 (SEQ ID NO: 640) and S67314_PEA_1_T7 (SEQ ID NO: 641. Table 13 below describes the starting and ending position of this segment on each transcript.

TABLE 13

Segment location on transcripts

| Transcript name | Segment starting position | Segment ending position |
|---|---|---|
| S67314_PEA_1_T4 (SEQ ID NO:638) | 1 | 997 |
| S67314_PEA_1_T5 (SEQ ID NO:639) | 1 | 997 |
| S67314_PEA_1_T6 (SEQ ID NO:640) | 1 | 997 |
| S67314_PEA_1_T7 (SEQ ID NO:641 | 1 | 997 |

Segment cluster S67314_PEA_1_node_11 (SEQ ID NO: 643) according to the present invention is supported by 6 libraries. The number of libraries was determined as previously described. This segment can be found in the following transcript(s): S67314_PEA_1_T4 (SEQ ID NO: 638). Table 14 below describes the starting and ending position of this segment on each transcript.

TABLE 14

Segment location on transcripts

| Transcript name | Segment starting position | Segment ending position |
|---|---|---|
| S67314_PEA_1_T4 (SEQ ID NO:638) | 1273 | 2110 |

Segment cluster S67314_PEA_1_node_13 (SEQ ID NO: 644) according to the present invention is supported by 76 libraries. The number of libraries was determined as previously described. This segment can be found in the following transcript(s): S67314_PEA_1_T7 (SEQ ID NO: 641. Table 15 below describes the starting and ending position of this segment on each transcript.

TABLE 15

Segment location on transcripts

| Transcript name | Segment starting position | Segment ending position |
| --- | --- | --- |
| S67314_PEA_1_T7 (SEQ ID NO:641 | 1306 | 3531 |

Segment cluster S67314_PEA_1_node_15 (SEQ ID NO: 645) according to the present invention is supported by 1 libraries. The number of libraries was determined as previously described. This segment can be found in the following transcript(s): S67314_PEA_1_T5 (SEQ ID NO: 639). Table 16 below describes the starting and ending position of this segment on each transcript.

TABLE 16

Segment location on transcripts

| Transcript name | Segment starting position | Segment ending position |
| --- | --- | --- |
| S67314_PEA_1_T5 (SEQ ID NO:639) | 1273 | 1733 |

Segment cluster S67314_PEA_1_node_17 (SEQ ID NO: 646) according to the present invention is supported by 4 libraries. The number of libraries was determined as previously described. This segment can be found in the following transcript(s): S67314_PEA_1_T6 (SEQ ID NO: 640). Table 17 below describes the starting and ending position of this segment on each transcript.

TABLE 17

Segment location on transcripts

| Transcript name | Segment starting position | Segment ending position |
| --- | --- | --- |
| S67314_PEA_1_T6 (SEQ ID NO:640) | 1273 | 1822 |

Microarray (chip) data is also available for this segment as follows. As described above with regard to the cluster itself, various oligonucleotides were tested for being differentially expressed in various disease conditions, particularly cancer. The following oligonucleotides were found to hit this segment (with regard to ovarian cancer), shown in Table 18.

TABLE 18

Oligonucleotides related to this segment

| Oligonucleotide name | Overexpressed in cancers | Chip reference |
| --- | --- | --- |
| S67314_0_0_744 (SEQ ID NO:1022) | ovarian carcinoma | OVA |

Segment cluster S67314_PEA_1_node_4 (SEQ ID NO: 647) according to the present invention is supported by 101 libraries. The number of libraries was determined as previously described. This segment can be found in the following transcript(s): S67314_PEA_1_T4 (SEQ ID NO: 638), S67314_PEA_1_T5 (SEQ ID NO: 639), S67314_PEA_1_T6 (SEQ ID NO: 640) and S67314_PEA_1_T7 (SEQ ID NO: 641. Table 19 below describes the starting and ending position of this segment on each transcript.

TABLE 19

Segment location on transcripts

| Transcript name | Segment starting position | Segment ending position |
| --- | --- | --- |
| S67314_PEA_1_T4 (SEQ ID NO:638) | 998 | 1170 |
| S67314_PEA_1_T5 (SEQ ID NO:639) | 998 | 1170 |
| S67314_PEA_1_T6 (SEQ ID NO:640) | 998 | 1170 |
| S67314_PEA_1_T7 (SEQ ID NO:641 | 1031 | 1203 |

According to an optional embodiment of the present invention, short segments related to the above cluster are also provided. These segments are up to about 120 bp in length, and so are included in a separate description.

Segment cluster S67314_PEA_1_node_10 (SEQ ID NO: 648) according to the present invention is supported by 64 libraries. The number of libraries was determined as previously described. This segment can be found in the following transcript(s): S67314_PEA_1_T4 (SEQ ID NO: 638), S67314_PEA_1_T5 (SEQ ID NO: 639), S67314_PEA_1_T6 (SEQ ID NO: 640) and S67314_PEA_1_T7 (SEQ ID NO: 641. Table 20 below describes the starting and ending position of this segment on each transcript.

TABLE 20

Segment location on transcripts

| Transcript name | Segment starting position | Segment ending position |
| --- | --- | --- |
| S67314_PEA_1_T4 (SEQ ID NO:638) | 1171 | 1272 |
| S67314_PEA_1_T5 (SEQ ID NO:639) | 1171 | 1272 |
| S67314_PEA_1_T6 (SEQ ID NO:640) | 1171 | 1272 |
| S67314_PEA_1_T7 (SEQ ID NO:641 | 1204 | 1305 |

Segment cluster S67314_PEA_1_node_3 (SEQ ID NO: 649) according to the present invention is supported by 1 libraries. The number of libraries was determined as previously described. This segment can be found in the following transcript(s): S67314_PEA_1_T7 (SEQ ID NO: 641. Table 21 below describes the starting and ending position of this segment on each transcript.

TABLE 21

Segment location on transcripts

| Transcript name | Segment starting position | Segment ending position |
|---|---|---|
| S67314_PEA_1_T7 (SEQ ID NO:641) | 998 | 1030 |

Variant protein alignment to the previously known protein:

Sequence name: /tmp/EQ0nMn6tqU/R73CUVKUk5:FABH_HUMAN

Sequence documentation:

Alignment of: S67314_PEA_1_P4 (SEQ ID NO: 651) x FABH_HUMAN . . .

Alignment segment 1/1:
  Quality: 1095.00

Escore: 0
  Matching length: 115 Total length: 115

Matching Percent Similarity: 100.00 Matching Percent Identity: 100.00
  Total Percent Similarity: 100.00 Total Percent Identity: 100.00
  Gaps: 0

Alignment:

```
  2  VDAFLGTWKLVDSKNFDDYMKSLGVGFATRQVASMTKPTTIIEKNGDILT   51
     |||||||||||||||||||||||||||||||||||||||||||||||||||
  1  VDAFLGTWKLVDSKNFDDYMKSLGVGFATRQVASMTKPTTIIEKNGDILT   50

52  LKTHSTFKNTEISFKLGVEFDETTADDRKVKSIVTLDGGKLVHLQKWDGQ  101
     |||||||||||||||||||||||||||||||||||||||||||||||||
 51  LKTHSTFKNTEISFKLGVEFDETTADDRKVKSIVTLDGGKLVHLQKWDGQ  100

102  ETTLVRELIDGKLIL                                    116
     |||||||||||||||
101  ETTLVRELIDGKLIL                                    115
```

Sequence name: /tmp/EQ0nMn6tqU/R73CUVKUk5: AAP35373

Sequence documentation:

Alignment of: S67314_PEA_1_P4 (SEQ ID NO: 651) x AAP35373 . . .

Alignment segment 1/1:
  Quality: 1107.00

Escore: 0
  Matching length: 116 Total length: 116

Matching Percent Similarity: 100.00 Matching Percent Identity: 100.00
  Total Percent Similarity: 100.00 Total Percent Identity: 100.00
  Gaps: 0

Alignment:

```
  1  MVDAFLGTWKLVDSKNFDDYMKSLGVGFATRQVASMTKPTTIIEKNGDIL   50
     |||||||||||||||||||||||||||||||||||||||||||||||||
  1  MVDAFLGTWKLVDSKNFDDYMKSLGVGFATRQVASMTKPTTIIEKNGDIL   50

51  TLKTHSTFKNTEISFKLGVEFDETTADDRKVKSIVTLDGGKLVHLQKWDG  100
     |||||||||||||||||||||||||||||||||||||||||||||||||
 51  TLKTHSTFKNTEISFKLGVEFDETTADDRKVKSIVTLDGGKLVHLQKWDG  100

101  QETTLVRELIDGKLIL                                   116
     ||||||||||||||||
101  QETTLVRELIDGKLIL                                   116
```

Sequence name: /tmp/ql4YPIBbdQ/SeofJfCmJW:FABH_HUMAN

Sequence documentation:

Alignment of: S67314_PEA_1_P5 (SEQ ID NO: 652) x FABH_HUMAN . . .

Alignment segment 1/1:
  Quality: 1095.00

Escore: 0
  Matching length: 115 Total length: 115

Matching Percent Similarity: 100.00 Matching Percent Identity: 100.00
  Total Percent Similarity: 100.00 Total Percent Identity: 100.00
  Gaps: 0

Alignment:

```
  2  VDAFLGTWKLVDSKNFDDYMKSLGVGFATRQVASMTKPTTIIEKNGDILT   51
     ||||||||||||||||||||||||||||||||||||||||||||||||||
  1  VDAFLGTWKLVDSKNFDDYMKSLGVGFATRQVASMTKPTTIIEKNGDILT   50

52  LKTHSTFKNTEISFKLGVEFDETTADDRKVKSIVTLDGGKLVHLQKWDGQ  101
     ||||||||||||||||||||||||||||||||||||||||||||||||||
 51  LKTHSTFKNTEISFKLGVEFDETTADDRKVKSIVTLDGGKLVHLQKWDGQ  100

102  ETTLVRELIDGKLIL                                     116
     |||||||||||||||
101  ETTLVRELIDGKLIL                                     115
```

Sequence name: /tmp/ql4YPIBbdQ/SeofJfCmJW: AAP35373

Sequence documentation:

Alignment of: S67314_PEA_1_P5 (SEQ ID NO: 652) x AAP35373 . . .

Alignment segment 1/1:
  Quality: 1107.00

Escore: 0
  Matching length: 116 Total length: 116

Matching Percent Similarity: 100.00 Matching Percent Identity: 100.00
  Total Percent Similarity: 100.00 Total Percent Identity: 100.00
  Gaps: 0

Alignment:

Sequence documentation:

Alignment of: S67314_PEA_1_P6 (SEQ ID NO: 653) x FABH_HUMAN . . .

Alignment segment 1/1:
  Quality: 1095.00

Escore: 0
  Matching length: 115 Total length: 115

Matching Percent Similarity: 100.00 Matching Percent Identity: 100.00
  Total Percent Similarity: 100.00 Total Percent Identity: 100.00
  Gaps: 0

Alignment:

```
  1  MVDAFLGTWKLVDSKNFDDYMKSLGVGFATRQVASMTKPTTIIEKNGDIL   50
     ||||||||||||||||||||||||||||||||||||||||||||||||||
  1  MVDAFLGTWKLVDSKNFDDYMKSLGVGFATRQVASMTKPTTIIEKNGDIL   50

51  TLKTHSTFKNTEISFKLGVEFDETTADDRKVKSIVTLDGGKLVHLQKWDG  100
     ||||||||||||||||||||||||||||||||||||||||||||||||||
 51  TLKTHSTFKNTEISFKLGVEFDETTADDRKVKSIVTLDGGKLVHLQKWDG  100

101  QETTLVRELIDGKLIL                                    116
     ||||||||||||||||
101  QETTLVRELIDGKLIL                                    116
```

Sequence name: /tmp/PXra2DxL1v/Q8GTrzNMVX: FABH_HUMAN

```
  2  VDAFLGTWKLVDSKNFDDYMKSLGVGFATRQVASMTKPTTIIEKNGDILT   51
     ||||||||||||||||||||||||||||||||||||||||||||||||||
  1  VDAFLGTWKLVDSKNFDDYMKSLGVGFATRQVASMTKPTTIIEKNGDILT   50

52  LKTHSTFKNTEISFKLGVEFDETTADDRKVKSIVTLDGGKLVHLQKWDGQ  101
     ||||||||||||||||||||||||||||||||||||||||||||||||||
 51  LKTHSTFKNTEISFKLGVEFDETTADDRKVKSIVTLDGGKLVHLQKWDGQ  100

102  ETTLVRELIDGKLIL                                     116
     |||||||||||||||
101  ETTLVRELIDGKLIL                                     115
```

Sequence name: /tmp/PXra2DxL1v/Q8GTrzNMVX: AAP35373

Sequence documentation:

Alignment of: S67314_PEA_1_P6 (SEQ ID NO: 653) x AAP35373 . . .

Alignment segment 1/1:
 Quality: 1107.00

Escore: 0
 Matching length: 116 Total length: 116

Matching Percent Similarity: 100.00 Matching Percent

Identity: 100.00
 Total Percent Similarity: 100.00 Total Percent

Identity: 100.00
 Gaps: 0

Alignment:

```
  1  MVDAFLGTWKLVDSKNFDDYMKSLGVGFATRQVASMTKPTTIIEKNGDIL   50
     ||||||||||||||||||||||||||||||||||||||||||||| ||||
  1  MVDAFLGTWKLVDSKNFDDYMKSLGVGFATRQASMTKPTTIIEKNFGDIL   50

51  TLKTHSTFKNTEISFKLGVEFDETTADDRKVKSIVTLDGGKLVHLQKWDG  100
     |||||||||||||||||||||||||||||||||||||||||||||||||
 51  TLKTHSTFKNTEISFKLGVEFDETTADDRKVKSIVTLDGGKLVHLQKWDG  100

101  QETTLVRELIDGKLIL                                    116
     ||||||||||||||||
101  QETTLVRELIDGKLIL                                    116
```

Escore: 0
 Matching length: 132 Total length: 143

Matching Percent Similarity: 100.00 Matching Percent

Identity: 100.00
 Total Percent Similarity: 92.31 Total Percent

Identity: 92.31
 Gaps: 1

Alignment:

```
  2  VDAFLGTWKLVDSKNFDDYMKSLAHILITFPLPSGVGFATRQVASMTKPT   51
     |||||||||||||||||||||                |||||||||||||
  1  VDAFLGTWKLVDSKNFDDYMKSL..........GVGFATRQVASMTKPT   39

52  TIIEKNGDILTLKTHSTFKNTEISFKLGVEFDETTADDRKVKSIVTLDGG  101
     |||||||||||||||||||||||||||||||||||||||||||||||||
 40  TIIEKNGDILTLKTHSTFKNTEISFKLGVEFDETTADDRKVKSIVTLDGG   89

102  KLVHLQKWDGQETTLVRELIDGKLILTLTHGTAVCTRTYEKEA         144
     ||||||||||||||||||||||||||||||||||||||||||
 90  KLVHLQKWDGQETTLVRELIDGKLILTLTHGTAVCTRTYEKEA         132
```

Sequence name: /tmp/xYzWyViDom/twDu3T69pd:FABH_HUMAN

Sequence documentation:

Alignment of: S67314_PEA_1_P7 (SEQ ID NO: 654) x FABH_HUMAN . . .

Alignment segment 1/1:
 Quality: 1160.00

Sequence name: /tmp/xYzWyViDom/twDu3T69pd: AAP35373

Sequence documentation:

Alignment of: S67314_PEA_1_P7 (SEQ ID NO: 654) x AAP35373 . . .

Alignment segment 1/1:
 Quality: 1172.00

Escore: 0
 Matching length: 133 Total
length: 144
Matching Percent Similarity: 100.00 Matching Percent
Identity: 100.00
 Total Percent Similarity: 92.36 Total Percent
Identity: 92.36
 Gaps: 1
Alignment:

```
  1  MVDAFLGTWKLVDSKNFDDYMKSLAHILITFPLPSGVGFATRQVASMTKP   50
     |||||||||||||||||||||||            |||||||||||||||
  1  MVDAFLGTWKLVDSKNFDDYMKSL...........GVGFATRQVASMTKP   39

51  TTIIEKNGDILTLKTHSTFKNTEISFKLGVEFDETTADDRKVKSIVTLDG  100
     |||||||||||||||||||||||||||||||||||||||||||||||||
 40  TTIIEKNGDILTLKTHSTFKNTEISFKLGVEFDETTADDRKVKSIVTLDG   89

101  GKLVHLQKWDGQETTLVRELIDGKLILTLTHGTAVCTRTYEKEA        144
     |||||||||||||||||||||||||||||||||||||||||||
 90  GKLVHLQKWDGQETTLVRELIDGKLILTLTHGTAVCTRTYEKEA        133
```

DESCRIPTION FOR CLUSTER Z39337

Cluster Z39337 features 3 transcript(s) and 12 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| Z39337_PEA_2_PEA_1_T3 | 655 |
| Z39337_PEA_2_PEA_1_T6 | 656 |
| Z39337_PEA_2_PEA_1_T12 | 657 |

TABLE 2

Segments of interest

| Segment Name | SEQ ID NO: |
|---|---|
| Z39337_PEA_2_PEA_1_node_2 | 658 |
| Z39337_PEA_2_PEA_1_node_15 | 659 |
| Z39337_PEA_2_PEA_1_node_16 | 660 |
| Z39337_PEA_2_PEA_1_node_18 | 661 |
| Z39337_PEA_2_PEA_1_node_21 | 662 |
| Z39337_PEA_2_PEA_1_node_22 | 663 |
| Z39337_PEA_2_PEA_1_node_3 | 664 |
| Z39337_PEA_2_PEA_1_node_5 | 665 |
| Z39337_PEA_2_PEA_1_node_6 | 666 |
| Z39337_PEA_2_PEA_1_node_10 | 667 |
| Z39337_PEA_2_PEA_1_node_11 | 668 |
| Z39337_PEA_2_PEA_1_node_14 | 669 |

TABLE 3

Proteins of interest

| Protein Name | SEQ ID NO: | Corresponding Transcript(s) |
|---|---|---|
| Z39337_PEA_2_PEA_1_P4 | 671 | Z39337_PEA_2_PEA_1_T3 (SEQ ID NO:655) |

TABLE 3-continued

Proteins of interest

| Protein Name | SEQ ID NO: | Corresponding Transcript(s) |
|---|---|---|
| Z39337_PEA_2_PEA_1_P9 | 672 | Z39337_PEA_2_PEA_1_T12 (SEQ ID NO:657) |
| Z39337_PEA_2_PEA_1_P13 | 673 | Z39337_PEA_2_PEA_1_T6 (SEQ ID NO:656) |

These sequences are variants of the known protein Kallikrein 6 precursor (SwissProt accession identifier KLK6_HUMAN; known also according to the synonyms EC 3.4.21.-; Protease M; Neurosin; Zyme; SP59), SEQ ID NO: 670, referred to herein as the previously known protein.

The sequence for protein Kallikrein 6 precursor is given at the end of the application, as "Kallikrein 6 precursor amino acid sequence". Protein Kallikrein 6 precursor localization is believed to be secreted.

The following GO Annotation(s) apply to the previously known protein. The following annotation(s) were found: central nervous system development; response to wounding; protein autoprocessing, which are annotation(s) related to Biological Process; chymotrypsin; tissue kallikrein; trypsin; protein binding; hydrolase, which are annotation(s) related to Molecular Function; and extracellular; cytoplasm, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster Z39337 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 34 refer to weighted expression of ESTs in each category, as "parts per million" (ratio of the expression of ESTs for a particular cluster to the expression of all ESTs in that category, according to parts per million).

Figure 34:
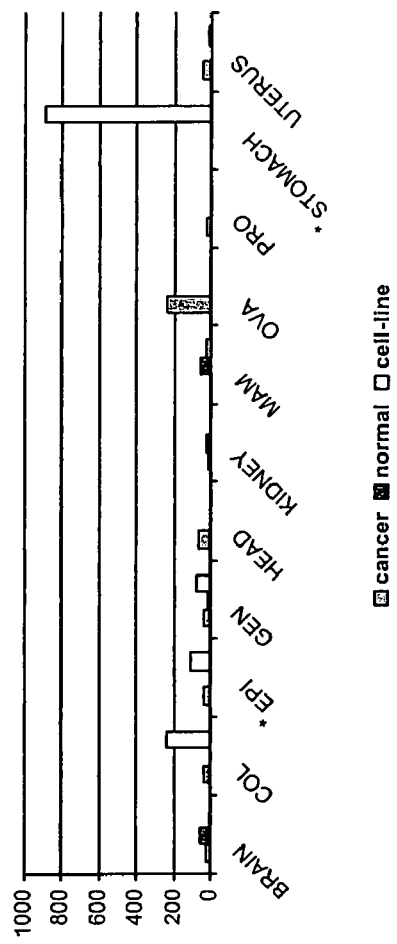
FIG. 34 shows cancer and cell-line vs. normal tissue expression.

Overall, the following results were obtained as shown with regard to the histograms in FIG. 34 and Table 4. This cluster is overexpressed (at least at a minimum level) in the following pathological conditions: epithelial malignant tumors and gastric carcinoma.

TABLE 4

Normal tissue distribution

| Name of Tissue | Number |
|---|---|
| brain | 56 |
| colon | 0 |
| epithelial | 3 |
| general | 11 |
| head and neck | 0 |
| kidney | 26 |
| breast | 52 |
| ovary | 0 |
| prostate | 0 |
| stomach | 0 |
| uterus | 0 |

TABLE 5

P values and ratios for expression in cancerous tissue

| Name of Tissue | P1 | P2 | SP1 | R3 | SP2 | R4 |
|---|---|---|---|---|---|---|
| brain | 8.0e−01 | 8.4e−01 | 9.6e−01 | 0.5 | 1 | 0.3 |
| colon | 1.2e−01 | 8.1e−02 | 4.9e−01 | 1.9 | 7.4e−02 | 2.2 |
| epithelial | 2.0e−02 | 1.8e−02 | 1.0e−05 | 4.3 | 7.8e−15 | 6.9 |
| general | 4.1e−02 | 1.1e−01 | 4.3e−06 | 2.3 | 1.6e−16 | 2.6 |
| head and neck | 2.1e−01 | 3.3e−01 | 1 | 1.7 | 1 | 1.2 |
| kidney | 8.9e−01 | 9.2e−01 | 8.2e−01 | 0.8 | 9.1e−01 | 0.6 |
| breast | 9.1e−01 | 9.1e−01 | 1 | 0.5 | 9.7e−01 | 0.6 |
| ovary | 1.4e−01 | 1.7e−01 | 4.7e−03 | 2.9 | 2.4e−02 | 2.2 |
| prostate | 7.3e−01 | 7.8e−01 | 4.5e−01 | 2.0 | 5.6e−01 | 1.7 |
| stomach | 3.6e−01 | 1.1e−01 | 1 | 1.0 | 8.9e−08 | 5.3 |
| uterus | 4.7e−01 | 4.0e−01 | 1.9e−01 | 2.0 | 3.3e−01 | 1.7 |

As noted above, cluster Z39337 features 3 transcript(s), which were listed in Table 1 above. These transcript(s) encode for protein(s) which are variant(s) of protein Kallikrein 6 precursor. A description of each variant protein according to the present invention is now provided.

Variant protein Z39337_PEA_2_PEA_1_P4 (SEQ ID NO: 671) according to the present invention has an amino acid sequence as given at the end of the application; it is encoded by transcript(s) Z39337_PEA_2_PEA_1_T3 (SEQ ID NO: 655). An alignment is given to the known protein (Kallikrein 6 precursor) at the end of the application. One or more alignments to one or more previously published protein sequences are given at the end of the application. A brief description of the relationship of the variant protein according to the present invention to each such aligned protein is as follows:

Comparison report between Z39337_PEA_2_PEA_1_P4 (SEQ ID NO: 671) and KLK6_HUMAN:

1. An isolated chimeric polypeptide encoding for Z39337_PEA_2_PEA_1_P4 (SEQ ID NO: 671), comprising a first amino acid sequence being at least 70%, optionally at least 80%, preferably at least 85%, more preferably at least 90% and most preferably at least 95% homologous to a polypeptide having the sequence MWLPLSGAA (SEQ ID NO: 1083) corresponding to amino acids 1-9 of Z39337_PEA_2_PEA_1_P4 (SEQ ID NO: 671), and a second amino acid sequence being at least 90% homologous to MKKLMVVLSLIAAAWAEEQNKLVHGG-PCDKTSHPYQAALYTSGHLLCGGVLIHPLWV LTAAHCKKPNLQVFLGKHNL- RQRESSQEQSSVVRAVIHPDYDAASH- DQDIMLLRLARP AKLSELIQPLPLERDC- SANTTSCHILGWGKTADGDFPDTIQCAYIHLVSREEC EHAYPGQ ITQNMLCAGDEKYGKDSCQGDSGG- PLVCGDHLRGLVSWGNIPCGSKEKPGVYTNVCR YTNWIQKTIQAK corresponding to amino acids 1-244 of KLK6_HUMAN, which also corresponds to amino acids 10-253 of Z39337_PEA_2_PEA_1_P4 (SEQ ID NO: 671), wherein said first amino acid sequence and second amino acid sequence are contiguous and in a sequential order.

2. An isolated polypeptide encoding for a head of Z39337_PEA_2_PEA_1_P4 (SEQ ID NO: 671), comprising a polypeptide being at least 70%, optionally at least about 80%, preferably at least about 85%, more preferably at least about 90% and most preferably at least about 95% homologous to the sequence MWLPLSGAA (SEQ ID NO: 1083) of Z39337_PEA_2_PEA_1_P4 (SEQ ID NO: 671).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z39337_PEA_2_PEA_1_P4 (SEQ ID NO: 671) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein Z39337_PEA_2_PEA_1_P4 (SEQ ID NO: 671) sequence provides support for the deduced sequence of this variant protein according to the present invention).

TABLE 6

Amino acid mutations

| SNP position(s) on amino acid sequence | Alternative amino acid(s) | Previously known SNP? |
|---|---|---|
| 238 | N −> | No |

The glycosylation sites of variant protein Z39337_PEA_2_PEA_1_P4 (SEQ ID NO: 671), as compared to the known protein Kallikrein 6 precursor, are described in Table 7 (given according to their position(s) on the amino acid sequence in the first column; the second column indicates whether the glycosylation site is present in the variant protein; and the last column indicates whether the position is different on the variant protein).

TABLE 7

Glycosylation site(s)

| Position(s) on known amino acid sequence | Present in variant protein? | Position in variant protein? |
|---|---|---|
| 134 | yes | 143 |

Variant protein Z39337_PEA_2_PEA_1_P4 (SEQ ID NO: 671) is encoded by the following transcript(s): Z39337_PEA_2_PEA_1_T3 (SEQ ID NO: 655), for which the sequence(s) is/are given at the end of the application. The coding portion of transcript Z39337_PEA_2_PEA_1_T3 (SEQ ID NO: 655) is shown in bold; this coding portion starts at position 87 and ends at position 845. The transcript also has the following SNPs as listed in Table 8 (given according to their position on the nucleotide sequence, with the alternative nucleic acid listed; the last column indicates whether the SNP is known or not; the presence of known SNPs in variant protein Z39337_PEA_2_PEA_1_P4 (SEQ ID NO: 671) sequence provides support for the deduced sequence of this variant protein according to the present invention).

TABLE 8

Nucleic acid SNPs

| SNP position on nucleotide sequence | Alternative nucleic acid | Previously known SNP? |
|---|---|---|
| 87 | A - >G | Yes |
| 396 | - >G | No |
| 599 | G - >C | Yes |
| 799 | A - > | No |
| 995 | C - > | No |
| 995 | C - >G | No |
| 1184 | C - > | No |
| 1294 | T - >A | Yes |

Variant protein Z39337_PEA_2_PEA_1_P9 (SEQ ID NO: 672) according to the present invention has an amino acid sequence as given at the end of the application; it is encoded by transcript(s) Z39337_PEA_2_PEA_1_T12 (SEQ ID NO: 657). An alignment is given to the known protein (Kallikrein 6 precursor) at the end of the application. One or more alignments to one or more previously published protein sequences are given at the end of the application. A brief description of the relationship of the variant protein according to the present invention to each such aligned protein is as follows:

Comparison report between Z39337_PEA_2_PEA_1_P9 (SEQ ID NO: 672) and KLK6_HUMAN:

1. An isolated chimeric polypeptide encoding for Z39337_PEA_2_PEA_1_P9 (SEQ ID NO: 672), comprising a first amino acid sequence being at least 90% homologous to MKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARP AKLSELIQPLPLERDCSANTTSCHILGWGKTADG corresponding to amino acids 1-149 of KLK6_HUMAN, which also corresponds to amino acids 1-149 of Z39337_PEA_2_PEA_1_P9 (SEQ ID NO: 672), and a second amino acid sequence being at least 70%, optionally at least 80%, preferably at least 85%, more preferably at least 90% and most preferably at least 95% homologous to a polypeptide having the sequence Q corresponding to amino acids 150-150 of Z39337_PEA_2_PEA_1_P9 (SEQ ID NO: 672), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide.

The glycosylation sites of variant protein Z39337_PEA_2_PEA_1_P9 (SEQ ID NO: 672), as compared to the known protein Kallikrein 6 precursor, are described in Table 9 (given according to their position(s) on the amino acid sequence in the first column; the second column indicates whether the glycosylation site is present in the variant protein; and the last column indicates whether the position is different on the variant protein).

TABLE 9

Glycosylation site(s)

| Position(s) on known amino acid sequence | Present in variant protein? | Position in variant protein? |
|---|---|---|
| 134 | yes | 134 |

Variant protein Z39337_PEA_2_PEA_1_P9 (SEQ ID NO: 672) is encoded by the following transcript(s): Z39337_PEA_2_PEA_1_T12 (SEQ ID NO: 657), for which the sequence(s) is/are given at the end of the application. The coding portion of transcript Z39337_PEA_2_PEA_1_T12 (SEQ ID NO: 657) is shown in bold; this coding portion starts at position 298 and ends at position 747. The transcript also has the following SNPs as listed in Table 10 (given according to their position on the nucleotide sequence, with the alternative nucleic acid listed; the last column indicates whether the SNP is known or not; the presence of known SNPs in variant protein Z39337_PEA_2_PEA_1_P9 (SEQ ID NO: 672) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 81 | G - > | No |
| 102 | G - >T | Yes |
| 147 | G - >A | Yes |
| 270 | G - > | No |
| 270 | G - >A | No |
| 580 | - >G | No |
| 784 | T - >C | Yes |
| 802 | G - >A | Yes |

Variant protein Z39337_PEA_2_PEA_1_P13 (SEQ ID NO: 673) according to the present invention has an amino acid sequence as given at the end of the application; it is encoded by transcript(s) Z39337_PEA_2_PEA_1_T6 (SEQ ID NO: 656). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z39337_PEA_2_PEA_1_P13 (SEQ ID NO: 673) is encoded by the following transcript(s): Z39337_PEA_2_PEA_1_T6 (SEQ ID NO: 656), for which the sequence(s) is/are given at the end of the application. The coding portion of transcript Z39337_PEA_2_PEA_1_T6 (SEQ ID NO: 656) is shown in bold; this coding portion starts at position 298 and ends at position 417. The transcript also has the following SNPs as listed in Table 11 (given according to their position on the nucleotide sequence, with the alternative nucleic acid listed; the last column indicates whether the SNP is known or not; the presence of known SNPs in variant protein Z39337_PEA_2_PEA_1_P13 (SEQ ID NO: 673) sequence provides support for the deduced sequence of this variant protein according to the present invention).

TABLE 11

Nucleic acid SNPs

| SNP position on nucleotide sequence | Alternative nucleic acid | Previously known SNP? |
|---|---|---|
| 81 | G - > | No |
| 102 | G - >T | Yes |
| 147 | G - >A | Yes |
| 270 | G - > | No |
| 270 | G - >A | No |
| 423 | - >G | No |
| 626 | G - >C | Yes |
| 826 | A - > | No |
| 1022 | C - > | No |
| 1022 | C - >G | No |
| 1211 | C - > | No |
| 1321 | T - >A | Yes |

As noted above, cluster Z39337 features 12 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster Z39337_PEA_2_PEA_1_node_2 (SEQ ID NO: 658) according to the present invention is supported by 23 libraries. The number of libraries was determined as previously described. This segment can be found in the following transcript(s): Z39337_PEA_2_PEA_1_T6 (SEQ ID NO: 656) and Z39337_PEA_2_PEA_1_T12 (SEQ ID NO: 657). Table 12 below describes the starting and ending position of this segment on each transcript.

TABLE 12

Segment location on transcripts

| Transcript name | Segment starting position | Segment ending position |
|---|---|---|
| Z39337_PEA_2_PEA_1_T6 (SEQ ID NO:656) | 1 | 237 |
| Z39337_PEA_2_PEA_1_T12 (SEQ ID NO:657) | 1 | 237 |

Segment cluster Z39337_PEA_2_PEA_1_node_15 (SEQ ID NO: 659) according to the present invention is supported by 54 libraries. The number of libraries was determined as previously described. This segment can be found in the following transcript(s): Z39337_PEA_2_PEA_1_T3 (SEQ ID NO: 655), Z39337_PEA_2_PEA_1_T6 (SEQ ID NO: 656) and Z39337_PEA_2_PEA_1_T12 (SEQ ID NO: 657). Table 13 below describes the starting and ending position of this segment on each transcript.

TABLE 13

Segment location on transcripts

| Transcript name | Segment starting position | Segment ending position |
|---|---|---|
| Z39337_PEA_2_PEA_1_T3 (SEQ ID NO: 655) | 363 | 558 |
| Z39337_PEA_2_PEA_1_T6 (SEQ ID NO: 656) | 390 | 585 |
| Z39337_PEA_2_PEA_1_T12 (SEQ ID NO: 657) | 547 | 742 |

Segment cluster Z39337_PEA_2_PEA_1_node_16 (SEQ ID NO: 660) according to the present invention is supported by 2 libraries. The number of libraries was determined as previously described. This segment can be found in the following transcript(s): Z39337_PEA_2_PEA_1_T12 (SEQ ID NO: 657). Table 14 below describes the starting and ending position of this segment on each transcript.

TABLE 14

Segment location on transcripts

| Transcript name | Segment starting position | Segment ending position |
|---|---|---|
| Z39337_PEA_2_PEA_1_T12 (SEQ ID NO: 657) | 743 | 1402 |

Segment cluster Z39337_PEA_2_PEA_1_node_18 (SEQ ID NO: 661) according to the present invention is supported by 53 libraries. The number of libraries was determined as previously described. This segment can be found in the following transcript(s): Z39337_PEA_2_PEA_1_T3 (SEQ ID NO: 655) and Z39337_PEA_2_PEA_1_T6 (SEQ ID NO: 656). Table 15 below describes the starting and ending position of this segment on each transcript.

TABLE 15

Segment location on transcripts

| Transcript name | Segment starting position | Segment ending position |
|---|---|---|
| Z39337_PEA_2_PEA_1_T3 (SEQ ID NO: 655) | 559 | 695 |
| Z39337_PEA_2_PEA_1_T6 (SEQ ID NO: 656) | 586 | 722 |

Segment cluster Z39337_PEA_2_PEA_1_node_21 (SEQ ID NO: 662) according to the present invention is supported by 81 libraries. The number of libraries was determined as previously described. This segment can be found in the following transcript(s): Z39337_PEA_2_PEA_1_T3 (SEQ ID NO: 655) and Z39337_PEA_2_PEA_1_T6 (SEQ ID NO: 656). Table 16 below describes the starting and ending position of this segment on each transcript.

TABLE 16

Segment location on transcripts

| Transcript name | Segment starting position | Segment ending position |
| --- | --- | --- |
| Z39337_PEA_2_PEA_1_T3 (SEQ ID NO: 655) | 696 | 1112 |
| Z39337_PEA_2_PEA 1T6 (SEQ ID NO: 656) | 723 | 1139 |

Microarray (chip) data is also available for this segment as follows. As described above with regard to the cluster itself, various oligonucleotides were tested for being differentially expressed in various disease conditions, particularly cancer. The following oligonucleotides were found to hit this segment (with regard to ovarian cancer), shown in Table 17.

TABLE 17

Oligonucleotides related to this segment

| Oligonucleotide name | Overexpressed in cancers | Chip reference |
| --- | --- | --- |
| Z39337_0_9_0 (SEQ ID NO: 1024) | ovarian carcinoma | OVA |

Segment cluster Z39337_PEA_2_PEA_1_node_22 (SEQ ID NO: 663) according to the present invention is supported by 58 libraries. The number of libraries was determined as previously described. This segment can be found in the following transcript(s): Z39337_PEA_2_PEA_1_T3 (SEQ ID NO: 655) and Z39337_PEA_2_PEA_1_T6 (SEQ ID NO: 656). Table 18 below describes the starting and ending position of this segment on each transcript.

TABLE 18

Segment location on transcripts

| Transcript name | Segment starting position | Segment ending position |
| --- | --- | --- |
| Z39337_PEA_2_PEA_1_T3 (SEQ ID NO: 655) | 1113 | 1387 |
| Z39337_PEA_2_PEA_1_T6 (SEQ ID NO: 656) | 1140 | 1414 |

According to an optional embodiment of the present invention, short segments related to the above cluster are also provided. These segments are up to about 120 bp in length, and so are included in a separate description.

Segment cluster Z39337_PEA_2_PEA_1_node_3 (SEQ ID NO: 664) according to the present invention is supported by 55 libraries. The number of libraries was determined as previously described. This segment can be found in the following transcript(s): Z39337_PEA_2_PEA_1_T6 (SEQ ID NO: 656) and Z39337_PEA_2_PEA_1_T12 (SEQ ID NO: 657). Table 19 below describes the starting and ending position of this segment on each transcript.

TABLE 19

Segment location on transcripts

| Transcript name | Segment starting position | Segment ending position |
| --- | --- | --- |
| Z39337_PEA_2_PEA_1_T6 (SEQ ID NO: 656) | 238 | 289 |
| Z39337_PEA_2_PEA_1_T12 (SEQ ID NO: 657) | 238 | 289 |

Segment cluster Z39337_PEA_2_PEA_1_node_5 (SEQ ID NO: 665) according to the present invention is supported by 1 libraries. The number of libraries was determined as previously described. This segment can be found in the following transcript(s): Z39337_PEA_2_PEA_1_T3 (SEQ ID NO: 655). Table 20 below describes the starting and ending position of this segment on each transcript.

TABLE 20

Segment location on transcripts

| Transcript name | Segment starting position | Segment ending position |
| --- | --- | --- |
| Z39337_PEA_2_PEA_1_T3 (SEQ ID NO: 655) | 1 | 105 |

Segment cluster Z39337_PEA_2_PEA_1_node_6 (SEQ ID NO: 666) according to the present invention is supported by 56 libraries. The number of libraries was determined as previously described. This segment can be found in the following transcript(s): Z39337_PEA_2_PEA_1_T3 (SEQ ID NO: 655), Z39337_PEA_2_PEA_1_T6 (SEQ ID NO: 656) and Z39337_PEA_2_PEA_1_T12 (SEQ ID NO: 657). Table 21 below describes the starting and ending position of this segment on each transcript.

TABLE 21

Segment location on transcripts

| Transcript name | Segment starting position | Segment ending position |
| --- | --- | --- |
| Z39337_PEA_2_PEA_1_T3 (SEQ ID NO: 655) | 106 | 153 |
| Z39337_PEA_2_PEA_1_T6 (SEQ ID NO: 656) | 290 | 337 |
| Z39337_PEA_2_PEA_1_T12 (SEQ ID NO: 657) | 290 | 337 |

Segment cluster Z39337_PEA_2_PEA_1_node_10 (SEQ ID NO: 667) according to the present invention is supported by 60 libraries. The number of libraries was determined as previously described. This segment can be found in the following transcript(s): Z39337_PEA_2_PEA_1_T3 (SEQ ID NO: 655) and Z39337_PEA_2_PEA_1_T12 (SEQ ID NO: 657). Table 22 below describes the starting and ending position of this segment on each transcript.

TABLE 22

Segment location on transcripts

| Transcript name | Segment starting position | Segment ending position |
|---|---|---|
| Z39337_PEA_2_PEA_1_T3 (SEQ ID NO: 655) | 154 | 207 |
| Z39337_PEA_2_PEA_1_T12 (SEQ ID NO: 657) | 338 | 391 |

Segment cluster Z39337_PEA_2_PEA_1_node_11 (SEQ ID NO: 668) according to the present invention is supported by 58 libraries. The number of libraries was determined as previously described. This segment can be found in the following transcript(s): Z39337_PEA_2_PEA_1_T3 (SEQ ID NO: 655) and Z39337_PEA_2_PEA_1_T12 (SEQ ID NO: 657). Table 23 below describes the starting and ending position of this segment on each transcript.

TABLE 23

Segment location on transcripts

| Transcript name | Segment starting position | Segment ending position |
|---|---|---|
| Z39337_PEA_2_PEA_1_T3 (SEQ ID NO: 655) | 208 | 310 |
| Z39337_PEA_2_PEA_1_T12 (SEQ ID NO: 657) | 392 | 494 |

TABLE 24

Segment location on transcripts

| Transcript name | Segment starting position | Segment ending position |
|---|---|---|
| Z39337_PEA_2_PEA_1_T3 (SEQ ID NO: 655) | 311 | 362 |
| Z39337_PEA_2_PEA_1_T6 (SEQ ID NO: 656) | 338 | 389 |
| Z39337_PEA_2_PEA_1_T12 (SEQ ID NO: 657) | 495 | 546 |

Variant protein alignment to the previously known protein:

Sequence name: KLK6_HUMAN

Sequence documentation:

Alignment of: Z39337_PEA_2_PEA_1_P4 (SEQ ID NO: 671) x KLK6_HUMAN . . .

Alignment segment 1/1:
   Quality: 2444.00

Escore: 0
   Matching length: 244 Total length: 244

Matching Percent Similarity: 100.00 Matching Percent

Identity: 100.00
   Total Percent Similarity: 100.00 Total Percent

Identity: 100.00
   Gaps: 0

Alignment:

```
 10 MKKLMVVLSLIAAAWAEEQNKLVHGGPCDKTSHPYQAALYTSGHLLCGGV  59
    |||||||||||||||||||||||||||||||||||||||||||||||||
  1 MKKLMVVLSLIAAAWAEEQNKLVHGGPCDKTSHPYQAALYTSGHLLCGGV  50

60 LIHPLWVLTAAHCKKPNLQVFLGKHNLRQRESSQEQSSVVRAVIHPDYDA 109
    |||||||||||||||||||||||||||||||||||||||||||||||||
 51 LIHPLWVLTAAHCKKPNLQVFLGKHNLRQRESSQEQSSVVRAVIHPDYDA 100

110 ASHDQDIMLLRLARPAKLSELIQPLPLERDCSANTTSCHILGWGKTADGD 159
    |||||||||||||||||||||||||||||||||||||||||||||||||
101 ASHDQDIMLLRLARPAKLSELIQPLPLERDCSANTTSCHILGWGKTADGD 150

160 FPDTIQCAYIHLVSREECEHAYPGQITQNMLCAGDEKYGKDSCQGDSGGP 209
    |||||||||||||||||||||||||||||||||||||||||||||||||
151 FPDTIQCAYIHLVSREECEHAYPGQITQNMLCAGDEKYGKDSCQGDSGGP 200

210 LVCGDHLRGLVSWGNIPCGSKEKPGVYTNVCRYTNWIQKTIQAK        253
    |||||||||||||||||||||||||||||||||||||||||||
201 LVCGDHLRGLVSWGNIPCGSKEKPGVYTNVCRYTNWIQKTIQAK        244
```

Segment cluster Z39337_PEA_2_PEA_1_node_14 (SEQ ID NO: 669) according to the present invention is supported by 49 libraries. The number of libraries was determined as previously described. This segment can be found in the following transcript(s): Z39337_PEA_2_PEA_1_T3 (SEQ ID NO: 655), Z39337_PEA_2_PEA_1_T6 (SEQ ID NO: 656) and Z39337_PEA_2_PEA_1_T12 (SEQ ID NO: 657). Table 24 below describes the starting and ending position of this segment on each transcript.

Sequence name: KLK6_HUMAN

Sequence documentation:
Alignment of: Z39337_PEA_2_PEA_1_P9 (SEQ ID NO: 672) x KLK6_HUMAN . . .

Alignment segment 1/1:
   Quality: 1471.00

Escore: 0
   Matching length: 149 Total length: 149

Matching Percent Similarity: 100.00 Matching Percent

Identity: 100.00
  Total Percent Similarity: 100.00 Total Percent

Identity: 100.00
  Gaps: 0

Alignment:

```
  1 MKKLMVVLSLIAAAWAEEQNKLVHGGPCDKTSHPYQAALYTSGHLLCGGV  50
    |||||||||||||||||||||||||||||||||||||||||||||||||
  1 MKKLMVVLSLIAAAWAEEQNKLVHGGPCDKTSHPYQAALYTSGHLLCGGV  50

51 LIHPLWVLTAAHCKKPNLQVFLGKHNLRQRESSQEQSSVVRAVIHPDYDA 100
    ||||||||||||||||||||||| |||||||||||||||||||||||||
 51 LIHPLWVLTAAHCKKPNLQVFLGJHNLRQRESSQEQSSVVRAVIHPDYDA 100

101 ASHDQDIMLLRLARPAKLSELIQPLPLERDCSANTTSCHILGWGKTADG  149
    ||||||||||||||||||||||||||||||||||||||||||||||||
101 ASHDQDIMLLRLARPAKLSELIQPLPLERDCSANTTSCHILGWGKTADG  149
```

DESCRIPTION FOR CLUSTER HUMPHOSLIP

Cluster HUMPHOSLIP features 7 transcript(s) and 53 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| HUMPHOSLIP_PEA_2_T6 | 674 |
| HUMPHOSLIP_PEA_2_T7 | 675 |
| HUMPHOSLIP_PEA_2_T14 | 676 |
| HUMPHOSLIP_PEA_2_T16 | 677 |
| HUMPHOSLIP_PEA_2_T17 | 678 |
| HUMPHOSLIP_PEA_2_T18 | 679 |
| HUMPHOSLIP_PEA_2_T19 | 680 |

TABLE 2

Segments of interest

| Segment Name | SEQ ID NO: |
|---|---|
| HUMPHOSLIP_PEA_2_node_0 | 681 |
| HUMPHOSLIP_PEA_2_node_19 | 682 |
| HUMPHOSLIP_PEA_2_node_34 | 683 |
| HUMPHOSLIP_PEA_2_node_68 | 684 |
| HUMPHOSLIP_PEA_2_node_70 | 685 |
| HUMPHOSLIP_PEA_2_node_75 | 686 |
| HUMPHOSLIP_PEA_2_node_2 | 687 |
| HUMPHOSLIP_PEA_2_node_3 | 688 |
| HUMPHOSLIP_PEA_2_node_4 | 689 |
| HUMPHOSLIP_PEA_2_node_6 | 690 |
| HUMPHOSLIP_PEA_2_node_7 | 691 |
| HUMPHOSLIP_PEA_2_node_8 | 692 |
| HUMPHOSLIP_PEA_2_node_9 | 693 |
| HUMPHOSLIP_PEA_2_node_14 | 694 |
| HUMPHOSLIP_PEA_2_node_15 | 695 |
| HUMPHOSLIP_PEA_2_node_16 | 696 |
| HUMPHOSLIP_PEA_2_node_17 | 697 |
| HUMPHOSLIP_PEA_2_node_23 | 698 |
| HUMPHOSLIP_PEA_2_node_24 | 699 |
| HUMPHOSLIP_PEA_2_node_25 | 700 |
| HUMPHOSLIP_PEA_2_node_26 | 701 |

TABLE 2-continued

Segments of interest

| Segment Name | SEQ ID NO: |
|---|---|
| HUMPHOSLIP_PEA_2_node_29 | 702 |
| HUMPHOSLIP_PEA_2_node_30 | 703 |

TABLE 2-continued

Segments of interest

| Segment Name | SEQ ID NO: |
|---|---|
| HUMPHOSLIP_PEA_2_node_33 | 704 |
| HUMPHOSLIP_PEA_2_node_36 | 705 |
| HUMPHOSLIP_PEA_2_node_37 | 706 |
| HUMPHOSLIP_PEA_2_node_39 | 707 |
| HUMPHOSLIP_PEA_2_node_40 | 708 |
| HUMPHOSLIP_PEA_2_node_41 | 709 |
| HUMPHOSLIP_PEA_2_node_42 | 710 |
| HUMPHOSLIP_PEA_2_node_44 | 711 |
| HUMPHOSLIP_PEA_2_node_45 | 712 |
| HUMPHOSLIP_PEA_2_node_47 | 713 |
| HUMPHOSLIP_PEA_2_node_51 | 714 |
| HUMPHOSLIP_PEA_2_node_52 | 715 |
| HUMPHOSLIP_PEA_2_node_53 | 716 |
| HUMPHOSLIP_PEA_2_node_54 | 717 |
| HUMPHOSLIP_PEA_2_node_55 | 718 |
| HUMPHOSLIP_PEA_2_node_58 | 719 |
| HUMPHOSLIP_PEA_2_node_59 | 720 |
| HUMPHOSLIP_PEA_2_node_60 | 721 |
| HUMPHOSLIP_PEA_2_node_61 | 722 |
| HUMPHOSLIP_PEA_2_node_62 | 723 |
| HUMPHOSLIP_PEA_2_node_63 | 724 |
| HUMPHOSLIP_PEA_2_node_64 | 725 |
| HUMPHOSLIP_PEA_2_node_65 | 726 |
| HUMPHOSLIP_PEA_2_node_66 | 727 |
| HUMPHOSLIP_PEA_2_node_67 | 728 |
| HUMPHOSLIP_PEA_2_node_69 | 729 |
| HUMPHOSLIP_PEA_2_node_71 | 730 |
| HUMPHOSLIP_PEA_2_node_72 | 731 |
| HUMPHOSLIP_PEA_2_node_73 | 732 |
| HUMPHOSLTP_PEA_2_node_74 | 733 |

TABLE 3

Proteins of interest

| Protein Name | SEQ ID NO: | Corresponding Transcript(s) |
|---|---|---|
| HUMPHOSLIP_PEA_2_P10 | 735 | HUMPHOSLIP_PEA_2_T17 (SEQ ID NO: 678) |

TABLE 3-continued

Proteins of interest

| Protein Name | SEQ ID NO: | Corresponding Transcript(s) |
|---|---|---|
| HUMPHOSLIP_PEA_2_P12 | 736 | HUMPHOSLIP_PEA_2_T19 (SEQ ID NO: 680) |
| HUMPHOSLIP_PEA_2_P30 | 737 | HUMPHOSLIP_PEA_2_T6 (SEQ ID NO: 674) |
| HUMPHOSLIP_PEA_2_P31 | 738 | HUMPHOSLIP_PEA_2_T7 (SEQ ID NO: 675) |
| HUMPHOSLIP_PEA_2_P33 | 739 | HUMPHOSLIP_PEA_2_T14 (SEQ ID NO: 676) |
| HUMPHOSLIP_PEA_2_P34 | 740 | HUMPHOSLIP_PEA_2_T16 (SEQ ID NO: 677) |
| HUMPHOSLIP_PEA_2_P35 | 741 | HUMPHOSLIP_PEA_2_T18 (SEQ ID NO: 679) |

These sequences are variants of the known protein Phospholipid transfer protein precursor (SwissProt accession identifier PLTP_HUMAN; known also according to the synonyms Lipid transfer protein II), SEQ ID NO: 734, referred to herein as the previously known protein.

Protein Phospholipid transfer protein precursor is known or believed to have the following function(s): Converts HDL into larger and smaller particles. May play a key role in extracellular phospholipid transport and modulation of HDL particles. The sequence for protein Phospholipid transfer protein precursor is given at the end of the application, as "Phospholipid transfer protein precursor amino acid sequence". Known polymorphisms for this sequence are as shown in Table 4.

TABLE 4

Amino acid mutations for Known Protein

| SNP position(s) on amino acid sequence | Comment |
|---|---|
| 282 | R - >Q./FTId= VAR_017020. |
| 372 | R - >H./FTId = VAR_017021. |
| 380 | R - >W (in dbSNP:6065903)./FTId = VAR_017022. |
| 444 | F - >L (in dbSNP:1804161)./FTId = VAR_012073. |
| 487 | T - >K (in dbSNP:1056929)./FTId = VAR_012074. |
| 18 | E - >V |

Protein Phospholipid transfer protein precursor localization is believed to be Secreted.

The following GO Annotation(s) apply to the previously known protein. The following annotation(s) were found: lipid metabolism; lipid transport, which are annotation(s) related to Biological Process; lipid binding, which are annotation(s) related to Molecular Function; and extracellular, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below (with regard to ovarian cancer), shown in Table 5.

TABLE 5

Oligonucleotides related to this cluster

| Oligonucleotide name | Overexpressed in cancers | Chip reference |
|---|---|---|
| HUMPHOSLIP_0_0_18458 (SEQ ID NO:1025) | ovarian carcinoma | OVA |

As noted above, cluster HUMPHOSLIP features 7 transcript(s), which were listed in Table 1 above. These transcript(s) encode for protein(s) which are variant(s) of protein Phospholipid transfer protein precursor. A description of each variant protein according to the present invention is now provided.

Variant protein HUMPHOSLIP_PEA_2_P10 (SEQ ID NO: 735) according to the present invention has an amino acid sequence as given at the end of the application; it is encoded by transcript(s) HUMPHOSLIP_PEA_2_T17 (SEQ ID NO: 678). An alignment is given to the known protein (Phospholipid transfer protein precursor) at the end of the application. One or more alignments to one or more previously published protein sequences are given at the end of the application. A brief description of the relationship of the variant protein according to the present invention to each such aligned protein is as follows:

Comparison report between HUMPHOSLIP_PEA_2_P10 (SEQ ID NO: 735) and PLTP_HUMAN:

1. An isolated chimeric polypeptide encoding for HUMPHOSLIP_PEA_2_P10 (SEQ ID NO: 735), comprising a first amino acid sequence being at least 90% homologous to MALFGALFLALLAGAHAEFPGCK-IRVTSKALELVKQEGLRFLEQELETITIPDLRGKEGH FYYNISE corresponding to amino acids 1-67 of PLTP_HUMAN, which also corresponds to amino acids 1-67 of HUMPHOSLIP_PEA_2_P10 (SEQ ID NO: 735), and a second amino acid sequence being at least 90% homologous to KVYDFLSTFITSGMRFLLNQQICPVLY-HAGTVLLNSLLDTVPVRSSVDELVGIDYSLMK DPVASTSNLDMDFRGAFFPLTERNWSLP-NRAVEPQLQEEERMVYVAFSEFFFDSAMES YFRAGALQLLLVGDKVPHDLDMLLRATY-FGSIVLLSPAVIDSPLKLELRVLAPPRCTIKP SGTTIS-VTASVTIALVPPDQPEVQLSSMTMDARL-SAKMALRGKALRTQLDLRRFRIYSN HSALESLALIPLQAPLKTMLQIGVMPML-NERTWRGVQIPLPEGINFVHEVVTNHAGFLTI GADL-HFAKGLREVIEKNRPADVRASTAPTPSTAAV corresponding to amino acids 163-493 of PLTP_HUMAN, which also corresponds to amino acids 68-398 of HUMPHOSLIP_PEA_2_P10 (SEQ ID NO: 735), wherein said first amino acid sequence and second amino acid sequence are contiguous and in a sequential order.

2. An isolated chimeric polypeptide encoding for an edge portion of HUMPHOSLIP_PEA_2_P10 (SEQ ID NO: 735), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EK, having a structure as follows: a sequence starting from any of amino acid numbers 67−x to 67; and ending at any of amino acid numbers 68+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P10 (SEQ ID NO: 735) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein HUMPHOSLIP_PEA_2_P10 (SEQ ID NO: 735) sequence provides support for the deduced sequence of this variant protein according to the present invention).

TABLE 6

Amino acid mutations

| SNP position(s) on amino acid sequence | Alternative amino acid(s) | Previously known SNP? |
|---|---|---|
| 16 | H − >R | Yes |
| 18 | E − >V | Yes |
| 113 | S − >F | Yes |
| 118 | V − > | No |
| 140 | R − > | No |
| 140 | R − >P | No |
| 150 | N − > | No |
| 160 | P − > | No |
| 201 | P − > | No |
| 274 | M − > | No |
| 285 | R − >W | Yes |
| 292 | Q − > | No |
| 315 | L − >* | No |
| 330 | M − >I | Yes |
| 349 | F − >L | Yes |
| 392 | T − >K | Yes |

The glycosylation sites of variant protein HUMPHOSLIP_PEA_2_P10 (SEQ ID NO: 735), as compared to the known protein Phospholipid transfer protein precursor, are described in Table 7 (given according to their position(s) on the amino acid sequence in the first column; the second column indicates whether the glycosylation site is present in the variant protein; and the last column indicates whether the position is different on the variant protein).

TABLE 7

Glycosylation site(s)

| Position(s) on known amino acid sequence | Present in variant protein? | Position in variant protein? |
|---|---|---|
| 94 | no | |
| 143 | no | |
| 64 | yes | 64 |
| 245 | yes | 150 |
| 398 | yes | 303 |
| 117 | no | |

Variant protein HUMPHOSLIP_PEA_2_P10 (SEQ ID NO: 735) is encoded by the following transcript(s): HUMPHOSLIP_PEA_2_T17 (SEQ ID NO: 678), for which the sequence(s) is/are given at the end of the application. The coding portion of transcript HUMPHOSLIP_PEA_2_T17 (SEQ ID NO: 678) is shown in bold; this coding portion starts at position 276 and ends at position 1469. The transcript also has the following SNPs as listed in Table 8 (given according to their position on the nucleotide sequence, with the alternative nucleic acid listed; the last column indicates whether the SNP is known or not; the presence of known SNPs in variant protein HUMPHOSLIP_PEA_2_P10 (SEQ ID NO: 735) sequence provides support for the deduced sequence of this variant protein according to the present invention).

TABLE 8

Nucleic acid SNPs

| SNP position on nucleotide sequence | Alternative nucleic acid | Previously known SNP? |
|---|---|---|
| 174 | G − >T | No |
| 175 | A − >T | No |
| 322 | A − >G | Yes |
| 328 | A − >T | Yes |
| 431 | G − >A | Yes |
| 551 | C − >T | Yes |
| 613 | C − >T | Yes |
| 628 | T − > | No |
| 694 | G − > | No |
| 694 | G − >C | No |
| 723 | A − > | No |
| 753 | C − > | No |
| 876 | C − > | No |
| 1037 | C − >T | Yes |
| 1097 | G − > | No |
| 1128 | C − >T | Yes |
| 1149 | C − > | No |
| 1219 | T − >A | No |
| 1230 | C − >T | Yes |
| 1265 | G − >C | Yes |
| 1322 | T − >A | Yes |
| 1450 | C − >A | Yes |
| 1469 | C − >T | No |
| 1549 | C − >T | Yes |
| 1565 | A − >G | No |
| 1565 | A − >T | No |
| 1630 | A − >G | Yes |
| 1654 | T − >A | No |
| 1731 | G − >T | Yes |
| 1864 | G − >A | Yes |
| 1893 | G − >T | Yes |
| 2073 | G − >A | Yes |
| 2269 | C − >T | Yes |
| 2325 | G − >T | Yes |
| 2465 | C − >T | Yes |
| 2566 | C − >T | Yes |
| 2881 | A − >G | No |

Variant protein HUMPHOSLIP_PEA_2_P12 (SEQ ID NO: 736) according to the present invention has an amino acid sequence as given at the end of the application; it is encoded by transcript(s) HUMPHOSLIP_PEA_2_T19 (SEQ ID NO: 680). An alignment is given to the known protein (Phospholipid transfer protein precursor) at the end of the application. One or more alignments to one or more previously published protein sequences are given at the end of the application. A brief description of the relationship of the variant protein according to the present invention to each such aligned protein is as follows:

Comparison report between HUMPHOSLIP_PEA_2_P12 (SEQ ID NO: 736) and PLTP_HUMAN:

1. An isolated chimeric polypeptide encoding for HUMPHOSLIP_PEA_2_P12 (SEQ ID NO: 736), comprising a first amino acid sequence being at least 90% homologous to MALFGALFLALLAGAHAEFPGCK-IRVTSKALELVKQEGLRFLEQELETITIPDLRGKEGH FYYNISEVKVTELQLTSSELD-
FQPQQELMLQITNASLGLRFRRQLLYW-
FFYDGGYINAS AEGVSIRTGLELSRDPAGRMKVSN-
VSCQASVSRMHAAFGGTFKKVYDFLSTFITSGMRF
LLNQQICPVLYHAGTVLLNSLL-
DTVPVRSSVDELVGIDYSLMKDPVASTSNLDMDFRG
AFFPLTERNWSLPNRAVEPQLQEEERM-
VYVAFSEFFFDSAMESYFRAGALQLLLVGDK VPH-
DLDMLLRATYFGSIVLLSPAVID-
SPLKLELRVLAPPRCTIKPSGTTISVTASVTIALVP
PDQPEVQLSSMTMDARLSAKMALRGKAL-
RTQLDLRRFRIYSNHSALESLALIPLQAPLK TML-
QIGVMPMLN corresponding to amino acids 1-427 of PLT-P_HUMAN, which also corresponds to amino acids 1-427 of HUMPHOSLIP_PEA_2_P12 (SEQ ID NO: 736), and a second amino acid sequence being at least 70%, optionally at least 80%, preferably at least 85%, more preferably at least 90% and most preferably at least 95% homologous to a polypeptide having the sequence GKAGV (SEQ ID NO: 1084) corresponding to amino acids 428-432 of HUMPHOSLIP_PEA_2_P12 (SEQ ID NO: 736), wherein said first amino acid sequence and second amino acid sequence are contiguous and in a sequential order.

2. An isolated polypeptide encoding for a tail of HUMPHOSLIP_PEA_2_P12 (SEQ ID NO: 736), comprising a polypeptide being at least 70%, optionally at least about 80%, preferably at least about 85%, more preferably at least about 90% and most preferably at least about 95% homologous to the sequence GKAGV (SEQ ID NO: 1084) in HUMPHOSLIP_PEA_2_P12 (SEQ ID NO: 736).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P12 (SEQ ID NO: 736) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein HUMPHOSLIP_PEA_2_P12 (SEQ ID NO: 736) sequence provides support for the deduced sequence of this variant protein according to the present invention).

TABLE 9

Amino acid mutations

| SNP position(s) on amino acid sequence | Alternative amino acid(s) | Previously known SNP? |
|---|---|---|
| 16 | H – >R | Yes |
| 18 | E – >V | Yes |
| 81 | D – >H | Yes |
| 124 | S – >Y | Yes |
| 160 | T – > | No |
| 160 | T – >N | No |
| 208 | S – >F | Yes |
| 213 | V – > | No |
| 235 | R – >P | No |
| 235 | R – > | No |
| 245 | N – > | No |

TABLE 9-continued

Amino acid mutations

| SNP position(s) on amino acid sequence | Alternative amino acid(s) | Previously known SNP? |
|---|---|---|
| 255 | P – > | No |
| 296 | P – > | No |
| 369 | M – > | No |
| 380 | R – >W | Yes |
| 387 | Q – > | No |
| 410 | L – >* | No |
| 425 | M – >I | Yes |

The glycosylation sites of variant protein HUMPHOSLIP_PEA_2_P12 (SEQ ID NO: 736), as compared to the known protein Phospholipid transfer protein precursor, are described in Table 10 (given according to their position(s) on the amino acid sequence in the first column; the second column indicates whether the glycosylation site is present in the variant protein; and the last column indicates whether the position is different on the variant protein).

TABLE 10

Glycosylation site(s)

| Position(s) on known amino acid sequence | Present in variant protein? | Position in variant protein? |
|---|---|---|
| 94 | yes | 94 |
| 143 | yes | 143 |
| 64 | yes | 64 |
| 245 | yes | 245 |
| 398 | yes | 398 |
| 117 | yes | 117 |

Variant protein HUMPHOSLIP_PEA_2_P12 (SEQ ID NO: 736) is encoded by the following transcript(s): HUMPHOSLIP_PEA_2_T19 (SEQ ID NO: 680), for which the sequence(s) is/are given at the end of the application. The coding portion of transcript HUMPHOSLIP_PEA_2_T19 (SEQ ID NO: 680) is shown in bold; this coding portion starts at position 276 and ends at position 1571. The transcript also has the following SNPs as listed in Table 11 (given according to their position on the nucleotide sequence, with the alternative nucleic acid listed; the last column indicates whether the SNP is known or not; the presence of known SNPs in variant protein HUMPHOSLIP_PEA_2_P12 (SEQ ID NO: 736) sequence provides support for the deduced sequence of this variant protein according to the present invention).

TABLE 11

Nucleic acid SNPs

| SNP position on nucleotide sequence | Alternative nucleic acid | Previously known SNP? |
|---|---|---|
| 174 | G – >T | No |
| 175 | A – >T | No |
| 322 | A – >G | Yes |
| 328 | A – >T | Yes |
| 431 | G – >A | Yes |
| 516 | G – >C | Yes |
| 644 | G – >A | Yes |
| 646 | C – >A | Yes |
| 754 | C – > | No |
| 754 | C – >A | No |
| 836 | C – >T | Yes |
| 898 | C – >T | Yes |
| 913 | T – > | No |

TABLE 11-continued

Nucleic acid SNPs

| SNP position on nucleotide sequence | Alternative nucleic acid | Previously known SNP? |
|---|---|---|
| 979 | G – > | No |
| 979 | G – >C | No |
| 1008 | A – > | No |
| 1038 | C – > | No |
| 1161 | C – > | No |
| 1322 | C – >T | Yes |
| 1382 | G – > | No |
| 1413 | C – >T | Yes |
| 1434 | C – > | No |
| 1504 | T – >A | No |
| 1515 | C – >T | Yes |
| 1550 | G – >C | Yes |
| 1690 | T – >A | Yes |
| 1818 | C – >A | Yes |
| 1837 | C – >T | No |
| 1917 | C – >T | Yes |
| 1933 | A – >G | No |
| 1933 | A – >T | No |
| 1998 | A – >G | Yes |
| 2022 | T – >A | No |
| 2099 | G – >T | Yes |
| 2232 | G – >A | Yes |
| 2261 | G – >T | Yes |
| 2441 | G – >A | Yes |
| 2637 | C – >T | Yes |
| 2693 | G – >T | Yes |
| 2833 | C – >T | Yes |
| 2934 | C – >T | Yes |
| 3249 | A – >G | No |

Variant protein HUMPHOSLIP_PEA_2_P30 (SEQ ID NO: 737) according to the present invention has an amino acid sequence as given at the end of the application; it is encoded by transcript(s) HUMPHOSLIP_PEA_2_T6 (SEQ ID NO: 674). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P30 (SEQ ID NO: 737) also has the following non-silent SNPs (Single Nucleotide Polymorphisms) as listed in Table 12, (given according to their position(s) on the amino acid sequence, with the alternative amino acid(s) listed; the last column indicates whether the SNP is known or not; the presence of known SNPs in variant protein HUMPHOSLIP_PEA_2_P30 (SEQ ID NO: 737) sequence provides support for the deduced sequence of this variant protein according to the present invention).

TABLE 12

Amino acid mutations

| SNP position(s) on amino acid sequence | Alternative amino acid(s) | Previously known SNP? |
|---|---|---|
| 16 | H – >R | Yes |
| 18 | E – >V | Yes |
| 37 | R – >Q | Yes |

Variant protein HUMPHOSLIP_PEA_2_P30 (SEQ ID NO: 737) is encoded by the following transcript(s): HUMPHOSLIP_PEA_2_T6 (SEQ ID NO: 674), for which the sequence(s) is/are given at the end of the application. The coding portion of transcript HUMPHOSLIP_PEA_2_T6 (SEQ ID NO: 674) is shown in bold; this coding portion starts at position 276 and ends at position 431. The transcript also has the following SNPs as listed in Table 13 (given according to their position on the nucleotide sequence, with the alternative nucleic acid listed; the last column indicates whether the SNP is known or not; the presence of known SNPs in variant protein HUMPHOSLIP_PEA_2_P30 (SEQ ID NO: 737) sequence provides support for the deduced sequence of this variant protein according to the present invention).

TABLE 13

Nucleic acid SNPs

| SNP position on nucleotide sequence | Alternative nucleic acid | Previously known SNP? |
|---|---|---|
| 174 | G – >T | No |
| 175 | A – >T | No |
| 322 | A – >G | Yes |
| 328 | A – >T | Yes |
| 385 | G – >A | Yes |
| 470 | G – >C | Yes |
| 598 | G – >A | Yes |
| 600 | C – >A | Yes |
| 708 | C – > | No |
| 708 | C – >A | No |
| 790 | C – >T | Yes |
| 852 | C – >T | Yes |
| 867 | T – > | No |
| 933 | G – > | No |
| 933 | G – >C | No |
| 962 | A – > | No |
| 992 | C – > | No |
| 1115 | C – > | No |
| 1276 | C – >T | Yes |
| 1336 | G – > | No |
| 1367 | C – >T | Yes |
| 1388 | C – > | No |
| 1458 | T – >A | No |
| 1469 | C – >T | Yes |
| 1504 | G – >C | Yes |
| 1561 | T – >A | Yes |
| 1689 | C – >A | Yes |
| 1708 | C – >T | No |
| 1788 | C – >T | Yes |
| 1804 | A – >G | No |
| 1804 | A – >T | No |
| 1869 | A – >G | Yes |
| 1893 | T – >A | No |
| 1970 | G – >T | Yes |
| 2103 | G – >A | Yes |
| 2132 | G – >T | Yes |
| 2312 | G – >A | Yes |
| 2508 | C – >T | Yes |
| 2564 | G – >T | Yes |
| 2704 | C – >T | Yes |
| 2805 | C – >T | Yes |
| 3120 | A – >G | No |

Variant protein HUMPHOSLIP_PEA_2_P31 (SEQ ID NO: 738) according to the present invention has an amino acid sequence as given at the end of the application; it is encoded by transcript(s) HUMPHOSLIP_PEA_2_T7 (SEQ ID NO: 675). An alignment is given to the known protein (Phospholipid transfer protein precursor) at the end of the application. One or more alignments to one or more previously published protein sequences are given at the end of the application. A brief description of the relationship of the variant protein according to the present invention to each such aligned protein is as follows:

Comparison report between HUMPHOSLIP_PEA_2_P31 (SEQ ID NO: 738) and PLTP_HUMAN:

1. An isolated chimeric polypeptide encoding for HUMPHOSLIP_PEA_2_P31 (SEQ ID NO: 738), comprising a first amino acid sequence being at least 90% homologous to MALFGALFLALLAGAHAEFPGCKIRVTSKALELVKQEGLRFLEQELETITIPDLRGKEGHFYYNISE corresponding to amino acids 1-67 of PLTP_HUMAN, which also corresponds to amino acids 1-67 of HUMPHOSLIP_PEA_2_P31 (SEQ ID NO: 738), and a second amino acid sequence being at least 70%, optionally at least 80%, preferably at least 85%, more preferably at least 90% and most preferably at least 95% homologous to a polypeptide having the sequence PGLERGADKFPVVGGSSLFLALDLTLRPPVG (SEQ ID NO: 1085) corresponding to amino acids 68-98 of HUMPHOSLIP_PEA_2_P31 (SEQ ID NO: 738), wherein said first amino acid sequence and second amino acid sequence are contiguous and in a sequential order.

2. An isolated polypeptide encoding for a tail of HUMPHOSLIP_PEA_2_P31 (SEQ ID NO: 738), comprising a polypeptide being at least 70%, optionally at least about 80%, preferably at least about 85%, more preferably at least about 90% and most preferably at least about 95% homologous to the sequence PGLERGADKFPVVGGSSLFLALDLTLRPPVG (SEQ ID NO: 1085) in HUMPHOSLIP_PEA_2_P31 (SEQ ID NO: 738).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P31 (SEQ ID NO: 738) also has the following non-silent SNPs (Single Nucleotide Polymorphisms) as listed in Table 14, (given according to their position(s) on the amino acid sequence, with the alternative amino acid(s) listed; the last column indicates whether the SNP is known or not; the presence of known SNPs in variant protein HUMPHOSLIP_PEA_2_P31 (SEQ ID NO: 738) sequence provides support for the deduced sequence of this variant protein according to the present invention).

TABLE 14

Amino acid mutations

| SNP position(s) on amino acid sequence | Alternative amino acid(s) | Previously known SNP? |
|---|---|---|
| 16 | H - >R | Yes |
| 18 | E - >V | Yes |

The glycosylation sites of variant protein HUMPHOSLIP_PEA_2_P31 (SEQ ID NO: 738), as compared to the known protein Phospholipid transfer protein precursor, are described in Table 15 (given according to their position(s) on the amino acid sequence in the first column; the second column indicates whether the glycosylation site is present in the variant protein; and the last column indicates whether the position is different on the variant protein).

TABLE 15

Glycosylation site(s)

| Position(s) on known amino acid sequence | Present in variant protein | Position in variant protein |
|---|---|---|
| 94 | no | |
| 143 | no | |
| 64 | yes | 64 |
| 245 | no | |
| 398 | no | |
| 117 | no | |

Variant protein HUMPHOSLIP_PEA_2_P31 (SEQ ID NO: 738) is encoded by the following transcript(s): HUMPHOSLIP_PEA_2_T7 (SEQ ID NO: 675), for which the sequence(s) is/are given at the end of the application. The coding portion of transcript HUMPHOSLIP_PEA_2_T7 (SEQ ID NO: 675) is shown in bold; this coding portion starts at position 276 and ends at position 569. The transcript also has the following SNPs as listed in Table 16 (given according to their position on the nucleotide sequence, with the alternative nucleic acid listed; the last column indicates whether the SNP is known or not; the presence of known SNPs in variant protein HUMPHOSLIP_PEA_2_P31 (SEQ ID NO: 738) sequence provides support for the deduced sequence of this variant protein according to the present invention).

TABLE 16

Nucleic acid SNPs

| SNP position on nucleotide sequence | Alternative nucleic acid | Previously known SNP? |
|---|---|---|
| 174 | G - >T | No |
| 175 | A - >T | No |
| 322 | A - >G | Yes |
| 328 | A - >T | Yes |
| 431 | G - >A | Yes |
| 608 | G - >C | Yes |
| 736 | G - >A | Yes |
| 738 | C - >A | Yes |
| 846 | C - > | No |
| 846 | C - >A | No |
| 928 | C - >T | Yes |
| 990 | C - >T | Yes |
| 1005 | T - > | No |
| 1071 | G - > | No |
| 1071 | G - >C | No |
| 1100 | A - > | No |
| 1130 | C - > | No |
| 1253 | C - > | No |
| 1414 | C - >T | Yes |
| 1474 | G - > | No |
| 1505 | C - >T | Yes |
| 1526 | C - > | No |
| 1596 | T - >A | No |
| 1607 | C - >T | Yes |
| 1642 | G - >C | Yes |
| 1699 | T < >A | Yes |
| 1827 | C - >A | Yes |
| 1846 | C - >T | No |
| 1926 | C - >T | Yes |
| 1942 | A - >G | No |
| 1942 | A - >T | No |
| 2007 | A - >G | Yes |
| 2031 | T - >A | No |
| 2108 | G - >T | Yes |
| 2241 | G - >A | Yes |
| 2270 | G - >T | Yes |
| 2450 | G - >A | Yes |
| 2646 | C - >T | Yes |
| 2702 | G - >T | Yes |
| 2842 | C - >T | Yes |

TABLE 16-continued

Nucleic acid SNPs

| SNP position on nucleotide sequence | Alternative nucleic acid | Previously known SNP? |
|---|---|---|
| 2943 | C - >T | Yes |
| 3258 | A - >G | No |

Variant protein HUMPHOSLIP_PEA_2_P33 (SEQ ID NO: 739) according to the present invention has an amino acid sequence as given at the end of the application; it is encoded by transcript(s) HUMPHOSLIP_PEA_2_T14 (SEQ ID NO: 676). An alignment is given to the known protein (Phospholipid transfer protein precursor) at the end of the application. One or more alignments to one or more previously published protein sequences are given at the end of the application. A brief description of the relationship of the variant protein according to the present invention to each such aligned protein is as follows:

Comparison report between HUMPHOSLIP_PEA_2_P33 (SEQ ID NO: 739) and PLTP_HUMAN:

1. An isolated chimeric polypeptide encoding for HUMPHOSLIP_PEA_2_P33 (SEQ ID NO: 739), comprising a first amino acid sequence being at least 90% homologous to MALFGALFLALLAGAHAEFPGCK-IRVTSKALELVKQEGLRFLEQELETITIPDLRGKEGH FYYNISEVKVTELQLTSSELD-FQPQQELMLQITNASLGLRFRRQLLYW-FFYDGGYINAS AEGVSIRTGLELSRDPAGRMKVSN-VSCQASVSRMHAAFGGTFKKVYDFLSTFITSGMRF LLNQQ corresponding to amino acids 1-183 of PLTP_HUMAN, which also corresponds to amino acids 1-183 of HUMPHOSLIP_PEA_2_P33 (SEQ ID NO: 739), and a second amino acid sequence being at least 70%, optionally at least 80%, preferably at least 85%, more preferably at least 90% and most preferably at least 95% homologous to a polypeptide having the sequence VWAATGRRVARVGMLSL (SEQ ID NO: 1086) corresponding to amino acids 184-200 of HUMPHOSLIP_PEA_2_P33 (SEQ ID NO: 739), wherein said first amino acid sequence and second amino acid sequence are contiguous and in a sequential order.

2. An isolated polypeptide encoding for a tail of HUMPHOSLIP_PEA_2_P33 (SEQ ID NO: 739), comprising a polypeptide being at least 70%, optionally at least about 80%, preferably at least about 85%, more preferably at least about 90% and most preferably at least about 95% homologous to the sequence VWAATGRRVARVGMLSL (SEQ ID NO: 1086) in HUMPHOSLIP_PEA_2_P33 (SEQ ID NO: 739).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P33 (SEQ ID NO: 739) also has the following non-silent SNPs (Single Nucleotide Polymorphisms) as listed in Table 17, (given according to their position(s) on the amino acid sequence, with the alternative amino acid(s) listed; the last column indicates whether the SNP is known or not; the presence of known SNPs in variant protein HUMPHOSLIP_PEA_2_P33 (SEQ ID NO: 739) sequence provides support for the deduced sequence of this variant protein according to the present invention).

TABLE 17

Amino acid mutations

| SNP position(s) on amino acid sequence | Alternative amino acid(s) | Previously known SNP? |
|---|---|---|
| 16 | H - >R | Yes |
| 18 | E - >V | Yes |
| 81 | D - >H | Yes |
| 124 | S - >Y | Yes |
| 160 | T - > | No |
| 160 | T - >N | No |

The glycosylation sites of variant protein HUMPHOSLIP_PEA_2_P33 (SEQ ID NO: 739), as compared to the known protein Phospholipid transfer protein precursor, are described in Table 18 (given according to their position(s) on the amino acid sequence in the first column; the second column indicates whether the glycosylation site is present in the variant protein; and the last column indicates whether the position is different on the variant protein).

TABLE 18

Glycosylation site(s)

| Position(s) on known amino acid sequence | Present in variant protein? | Position in variant protein? |
|---|---|---|
| 94 | yes | 94 |
| 143 | yes | 143 |
| 64 | yes | 64 |
| 245 | no | |
| 398 | no | |
| 117 | yes | 117 |

Variant protein HUMPHOSLIP_PEA_2_P33 (SEQ ID NO: 739) is encoded by the following transcript(s): HUMPHOSLIP_PEA_2_T14 (SEQ ID NO: 676), for which the sequence(s) is/are given at the end of the application. The coding portion of transcript HUMPHOSLIP_PEA_2_T14 (SEQ ID NO: 676) is shown in bold; this coding portion starts at position 276 and ends at position 875. The transcript also has the following SNPs as listed in Table 19 (given according to their position on the nucleotide sequence, with the alternative nucleic acid listed; the last column indicates whether the SNP is known or not; the presence of known SNPs in variant protein HUMPHOSLIP_PEA_2_P33 (SEQ ID NO: 739) sequence provides support for the deduced sequence of this variant protein according to the present invention).

TABLE 19

Nucleic acid SNPs

| SNP position on nucleotide sequence | Alternative nucleic acid | Previously known SNP? |
|---|---|---|
| 174 | G - >T | No |
| 175 | A - >T | No |
| 322 | A - >G | Yes |
| 328 | A - >T | Yes |
| 431 | G - >A | Yes |
| 516 | G - >C | Yes |
| 644 | G - >A | Yes |
| 646 | C - >A | Yes |
| 754 | C - > | No |
| 754 | C - >A | No |

TABLE 19-continued

Nucleic acid SNPs

| SNP position on nucleotide sequence | Alternative nucleic acid | Previously known SNP? |
|---|---|---|
| 921 | C - >T | Yes |
| 983 | C - >T | Yes |
| 998 | T - > | No |
| 1064 | G - > | No |
| 1064 | G - >C | No |
| 1093 | A - > | No |
| 1123 | C - > | No |
| 1246 | C - > | No |
| 1407 | C - >T | Yes |
| 1467 | G - > | No |
| 1498 | C - >T | Yes |
| 1519 | C - > | No |
| 1589 | T - >A | No |
| 1600 | C - >T | Yes |
| 1635 | G - >C | Yes |
| 1692 | T - >A | Yes |
| 1820 | C - >A | Yes |
| 1839 | C - >T | No |
| 1919 | C - >T | Yes |
| 1935 | A - >G | No |
| 1935 | A - >T | No |
| 2000 | A - >G | Yes |
| 2024 | T - >A | No |
| 2101 | G - >T | Yes |
| 2234 | G - >A | Yes |
| 2263 | G - >T | Yes |
| 2443 | G - >A | Yes |
| 2639 | C - >T | Yes |
| 2695 | G - >T | Yes |
| 2835 | C - >T | Yes |
| 2936 | C - >T | Yes |
| 3251 | A - >G | No |

Variant protein HUMPHOSLIP_PEA_2_P34 (SEQ ID NO: 740) according to the present invention has an amino acid sequence as given at the end of the application; it is encoded by transcript(s) HUMPHOSLIP_PEA_2_T16 (SEQ ID NO: 677). An alignment is given to the known protein (Phospholipid transfer protein precursor) at the end of the application. One or more alignments to one or more previously published protein sequences are given at the end of the application. A brief description of the relationship of the variant protein according to the present invention to each such aligned protein is as follows:

Comparison report between HUMPHOSLIP_PEA_2_P34 (SEQ ID NO: 740) and PLTP_HUMAN:

1. An isolated chimeric polypeptide encoding for HUMPHOSLIP_PEA_2_P34 (SEQ ID NO: 740), comprising a first amino acid sequence being at least 90% homologous to MALFGALFLALLAGAHAEFPGCK-IRVTSKALELVKQEGLRFLEQELETITIPDLRGKEGH FYYNISEVKVTELQLTSSELD-FQPQQELMLQITNASLGLRFRRQLLYW-FFYDGGYINAS AEGVSIRTGLELSRDPAGRMKVSN-VSCQASVSRMHAAFGGTFKKVYDFLSTFITSGMRF LLNQQICPVLYHAGTVLLNSLLDTVPV corresponding to amino acids 1-205 of PLTP_HUMAN, which also corresponds to amino acids 1-205 of HUMPHOSLIP_PEA_2_P34 (SEQ ID NO: 740), and a second amino acid sequence being at least 70%, optionally at least 80%, preferably at least 85%, more preferably at least 90% and most preferably at least 95% homologous to a polypeptide having the sequence LWTSLLALTIPS (SEQ ID NO: 1087) corresponding to amino acids 206-217 of HUMPHOSLIP_PEA_2_P34 (SEQ ID NO: 740), wherein said first amino acid sequence and second amino acid sequence are contiguous and in a sequential order.

2. An isolated polypeptide encoding for a tail of HUMPHOSLIP_PEA_2_P34 (SEQ ID NO: 740), comprising a polypeptide being at least 70%, optionally at least about 80%, preferably at least about 85%, more preferably at least about 90% and most preferably at least about 95% homologous to the sequence LWTSLLALTIPS (SEQ ID NO: 1087) in HUMPHOSLIP_PEA_2_P34 (SEQ ID NO: 740).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P34 (SEQ ID NO: 740) also has the following non-silent SNPs (Single Nucleotide Polymorphisms) as listed in Table 20, (given according to their position(s) on the amino acid sequence, with the alternative amino acid(s) listed; the last column indicates whether the SNP is known or not; the presence of known SNPs in variant protein HUMPHOSLIP_PEA_2_P34 (SEQ ID NO: 740) sequence provides support for the deduced sequence of this variant protein according to the present invention).

TABLE 20

Amino acid mutations

| SNP position(s) on amino acid sequence | Alternative amino acid(s) | Previously known SNP? |
|---|---|---|
| 16 | H - >R | Yes |
| 18 | E - >V | Yes |
| 81 | D - >H | Yes |
| 124 | S - >Y | Yes |
| 160 | T - > | No |
| 160 | T - >N | No |
| 211 | L - > | No |

The glycosylation sites of variant protein HUMPHOSLIP_PEA_2_P34 (SEQ ID NO: 740), as compared to the known protein Phospholipid transfer protein precursor, are described in Table 21 (given according to their position(s) on the amino acid sequence in the first column; the second column indicates whether the glycosylation site is present in the variant protein; and the last column indicates whether the position is different on the variant protein).

TABLE 21

Glycosylation site(s)

| Position(s) on known amino acid sequence | Present in variant protein? | Position in variant protein? |
|---|---|---|
| 94 | yes | 94 |
| 143 | yes | 143 |
| 64 | yes | 64 |
| 245 | no | |
| 398 | no | |
| 117 | yes | 117 |

Variant protein HUMPHOSLIP_PEA_2_P34 (SEQ ID NO: 740) is encoded by the following transcript(s): HUM- PHOSLIP_PEA_2_T16 (SEQ ID NO: 677), for which the sequence(s) is/are given at the end of the application. The coding portion of transcript HUMPHOSLIP_PEA_2_T16 (SEQ ID NO: 677) is shown in bold; this coding portion starts at position 276 and ends at position 926. The transcript also has the following SNPs as listed in Table 22 (given according to their position on the nucleotide sequence, with the alternative nucleic acid listed; the last column indicates whether the SNP is known or not; the presence of known SNPs in variant protein HUMPHOSLIP_PEA_2_P34 (SEQ ID NO: 740) sequence provides support for the deduced sequence of this variant protein according to the present invention).

TABLE 22

Nucleic acid SNPs

| SNP position on nucleotide sequence | Alternative nucleic acid | Previously known SNP? |
|---|---|---|
| 174 | G - >T | No |
| 175 | A - >T | No |
| 322 | A - >G | Yes |
| 328 | A - >T | Yes |
| 431 | G - >A | Yes |
| 516 | G - >C | Yes |
| 644 | G - >A | Yes |
| 646 | C - >A | Yes |
| 754 | C - > | No |
| 754 | C - >A | No |
| 836 | C - >T | Yes |
| 891 | C - >T | Yes |
| 906 | T - > | No |
| 972 | G - > | No |
| 972 | G - >C | No |
| 1001 | A - > | No |
| 1031 | C - > | No |
| 1154 | C - > | No |
| 1315 | C - >T | Yes |
| 1375 | G - > | No |
| 1406 | C - >T | Yes |
| 1427 | C - > | No |
| 1497 | T - >A | No |
| 1508 | C - >T | Yes |
| 1543 | G - >C | Yes |
| 1600 | T - >A | Yes |
| 1728 | C - >A | Yes |
| 1747 | C - >T | No |
| 1827 | C - >T | Yes |
| 1843 | A - >G | No |
| 1843 | A - >T | No |
| 1908 | A - >G | Yes |
| 1932 | T - >A | No |
| 2009 | G - >T | Yes |
| 2142 | G - >A | Yes |
| 2171 | G - >T | Yes |
| 2351 | G - >A | Yes |
| 2547 | C - >T | Yes |
| 2603 | G - >T | Yes |
| 2743 | C - >T | Yes |
| 2844 | C - >T | Yes |
| 3159 | A - >G | No |

Variant protein HUMPHOSLIP_PEA_2_P35 (SEQ ID NO: 741) according to the present invention has an amino acid sequence as given at the end of the application; it is encoded by transcript(s) HUMPHOSLIP_PEA_2_T18 (SEQ ID NO: 679). An alignment is given to the known protein (Phospholipid transfer protein precursor) at the end of the application. One or more alignments to one or more previously published protein sequences are given at the end of the application. A brief description of the relationship of the variant protein according to the present invention to each such aligned protein is as follows:

Comparison report between HUMPHOSLIP_PEA_2_P35 (SEQ ID NO: 741) and PLTP_HUMAN:

1. An isolated chimeric polypeptide encoding for HUMPHOSLIP_PEA_2_P35 (SEQ ID NO: 741), comprising a first amino acid sequence being at least 90% homologous to MALFGALFLALLAGAHAEFPGCK-IRVTSKALELVKQEGLRFLEQELETITIPDLRGKEGH FYYNISEVKVTELQLTSSELD-FQPQQELMLQITNASLGLRFRRQLLYWF corresponding to amino acids 1-109 of PLTP_HUMAN, which also corresponds to amino acids 1-109 of HUMPHOSLIP_PEA_2_P35 (SEQ ID NO: 741), a second amino acid sequence bridging amino acid sequence comprising of L, a third amino acid sequence being at least 90% homologous to KVYDFL-STFITSGMRFLLNQQ corresponding to amino acids 163-183 of PLTP_HUMAN, which also corresponds to amino acids 111-131 of HUMPHOSLIP_PEA_2_P35 (SEQ ID NO: 741), and a fourth amino acid sequence being at least 70%, optionally at least 80%, preferably at least 85%, more preferably at least 90% and most preferably at least 95% homologous to a polypeptide having the sequence VWAAT-GRRVARVGMLSL (SEQ ID NO: 1086) corresponding to amino acids 132-148 of HUMPHOSLIP_PEA_2_P35 (SEQ ID NO: 741), wherein said first amino acid sequence, second amino acid sequence, third amino acid sequence and fourth amino acid sequence are contiguous and in a sequential order.

2. An isolated polypeptide encoding for an edge portion of HUMPHOSLIP_PEA_2_P35 (SEQ ID NO: 741), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise FLK having a structure as follows (numbering according to HUMPHOSLIP_PEA_2_P35 (SEQ ID NO: 741)): a sequence starting from any of amino acid numbers 109−x to 109; and ending at any of amino acid numbers 111+((n−2)−x), in which x varies from 0 to n−2.

3. An isolated polypeptide encoding for a tail of HUMPHOSLIP_PEA_2_P35 (SEQ ID NO: 741), comprising a polypeptide being at least 70%, optionally at least about 80%, preferably at least about 85%, more preferably at least about 90% and most preferably at least about 95% homologous to the sequence VWAATGRRVARVGMLSL (SEQ ID NO: 1086) in HUMPHOSLIP_PEA_2_P35 (SEQ ID NO: 741).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P35 (SEQ ID NO: 741) also has the following non-silent SNPs (Single Nucleotide Polymorphisms) as listed in Table 23, (given according to their position(s) on the amino acid sequence, with the alternative amino acid(s) listed; the last column indicates whether the SNP is known or not; the presence of known SNPs in variant protein HUMPHOSLIP_PEA_2_P35 (SEQ ID NO: 741) sequence provides support for the deduced sequence of this variant protein according to the present invention).

TABLE 23

Amino acid mutations

| SNP position(s) on amino acid sequence | Alternative amino acid(s) | Previously known SNP? |
|---|---|---|
| 16 | H - >R | Yes |
| 18 | E - >V | Yes |
| 81 | D - >H | Yes |

The glycosylation sites of variant protein HUMPHOSLIP_PEA_2_P35 (SEQ ID NO: 741), as compared to the known protein Phospholipid transfer protein precursor, are described in Table 24 (given according to their position(s) on the amino acid sequence in the first column; the second column indicates whether the glycosylation site is present in the variant protein; and the last column indicates whether the position is different on the variant protein).

TABLE 24

Glycosylation site(s)

| Position(s) on known amino acid sequence | Present in variant protein? | Position in variant protein? |
|---|---|---|
| 94 | yes | 94 |
| 143 | no | |
| 64 | yes | 64 |
| 245 | no | |
| 398 | no | |
| 117 | no | |

Variant protein HUMPHOSLIP_PEA_2_P35 (SEQ ID NO: 741) is encoded by the following transcript(s): HUMPHOSLIP_PEA_2_T18 (SEQ ID NO: 679), for which the sequence(s) is/are given at the end of the application. The coding portion of transcript HUMPHOSLIP_PEA_2_T18 (SEQ ID NO: 679) is shown in bold; this coding portion starts at position 276 and ends at position 719. The transcript also has the following SNPs as listed in Table 25 (given according to their position on the nucleotide sequence, with the alternative nucleic acid listed; the last column indicates whether the SNP is known or not; the presence of known SNPs in variant protein HUMPHOSLIP_PEA_2_P35 (SEQ ID NO: 741) sequence provides support for the deduced sequence of this variant protein according to the present invention).

TABLE 25

Nucleic acid SNPs

| SNP position on nucleotide sequence | Alternative nucleic acid | Previously known SNP? |
|---|---|---|
| 174 | G - >T | No |
| 175 | A - >T | No |
| 322 | A - >G | Yes |
| 328 | A - >T | Yes |
| 431 | G - >A | Yes |
| 516 | G - >C | Yes |
| 765 | C - >T | Yes |
| 827 | C - >T | Yes |
| 842 | T - > | No |
| 908 | G - > | No |
| 908 | G - >C | No |
| 937 | A - > | No |
| 967 | C - > | No |
| 1090 | C - > | No |
| 1251 | C - >T | Yes |
| 1311 | G - > | No |
| 1342 | C - >T | Yes |
| 1363 | C - > | No |
| 1433 | T - >A | No |
| 1444 | C - >T | Yes |
| 1479 | G - >C | Yes |
| 1536 | T - >A | Yes |
| 1664 | C - >A | Yes |
| 1683 | C - >T | No |
| 1763 | C - >T | Yes |
| 1779 | A - >G | No |
| 1779 | A - >T | No |
| 1844 | A - >G | Yes |
| 1868 | T - >A | No |
| 1945 | G - >T | Yes |
| 2078 | G - >A | Yes |
| 2107 | G - >T | Yes |
| 2287 | G - >A | Yes |
| 2483 | C - >T | Yes |
| 2539 | G - >T | Yes |
| 2679 | C - >T | Yes |
| 2780 | C - >T | Yes |
| 3095 | A - >G | No |

As noted above, cluster HUMPHOSLIP features 53 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMPHOSLIP_PEA_2_node_0 (SEQ ID NO: 681) according to the present invention is supported by 150 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 26 below describes the starting and ending position of this segment on each transcript.

TABLE 26

Segment location on transcripts

| Transcript name | Segment starting position | Segment ending position |
|---|---|---|
| HUMPHOSLIP_PEA_2_T6 (SEQ ID NO:674) | 1 | 264 |
| HUMPHOSLIP_PEA_2_T7 (SEQ ID NO:675) | 1 | 264 |
| HUMPHOSLIP_PEA_2_T14 (SEQ ID NO:676) | 1 | 264 |
| HUMPHOSLIP_PEA_2_T16 (SEQ ID NO:677) | 1 | 264 |
| HUMPHOSLIP_PEA_2_T17 (SEQ ID NO:678) | 1 | 264 |
| HUMPHOSLIP_PEA_2_T18 (SEQ ID NO:679) | 1 | 264 |
| HUMPHOSLIP_PEA_2_T19 (SEQ ID NO:680) | 1 | 264 |

Segment cluster HUMPHOSLIP_PEA_2_node_19_ (SEQ ID NO: 682) according to the present invention is supported by 186 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677) and HUMPHOSLIP_PEA_2_T19 (SEQ ID NO: 680). Table 27 below describes the starting and ending position of this segment on each transcript.

TABLE 27

Segment location on transcripts

| Transcript name | Segment starting position | Segment ending position |
|---|---|---|
| HUMPHOSLIP_PEA_2_T6 (SEQ ID NO:674) | 559 | 714 |
| HUMPHOSLIP_PEA_2_T7 (SEQ ID NO:675) | 697 | 852 |
| HUMPHOSLIP_PEA_2_T14 (SEQ ID NO:676) | 605 | 760 |
| HUMPHOSLIP_PEA_2_T16 (SEQ ID NO:677) | 605 | 760 |
| HUMPHOSLIP_PEA_2_T19 (SEQ ID NO:680) | 605 | 760 |

Segment cluster HUMPHOSLIP_PEA_2_node_34 (SEQ ID NO: 683) according to the present invention is supported by 191 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 28 below describes the starting and ending position of this segment on each transcript.

TABLE 28

Segment location on transcripts

| Transcript name | Segment starting position | Segment ending position |
|---|---|---|
| HUMPHOSLIP_PEA_2_T6 (SEQ ID NO:674) | 971 | 1111 |
| HUMPHOSLIP_PEA_2_T7 (SEQ ID NO:675) | 1109 | 1249 |
| HUMPHOSLIP_PEA_2_T14 (SEQ ID NO:676) | 1102 | 1242 |
| HUMPHOSLIP_PEA_2_T16 (SEQ ID NO:677) | 1010 | 1150 |
| HUMPHOSLIP_PEA_2_T17 (SEQ ID NO:678) | 732 | 872 |
| HUMPHOSLIP_PEA_2_T18 (SEQ ID NO:679) | 946 | 1086 |
| HUMPHOSLIP_PEA_2_T19 (SEQ ID NO:680) | 1017 | 1157 |

Segment cluster HUMPHOSLIP_PEA_2_node_68 (SEQ ID NO: 684) according to the present invention is supported by 131 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 29 below describes the starting and ending position of this segment on each transcript.

TABLE 29

Segment location on transcripts

| Transcript name | Segment starting position | Segment ending position |
|---|---|---|
| HUMPHOSLIP_PEA_2_T6 (SEQ ID NO:674) | 1867 | 2285 |
| HUMPHOSLIP_PEA_2_T7 (SEQ ID NO:675) | 2005 | 2423 |
| HUMPHOSLIP_PEA_2_T14 (SEQ ID NO:676) | 1998 | 2416 |
| HUMPHOSLIP_PEA_2_T16 (SEQ ID NO:677) | 1906 | 2324 |
| HUMPHOSLIP_PEA_2_T17 (SEQ ID NO:678) | 1628 | 2046 |
| HUMPHOSLIP_PEA_2_T18 (SEQ ID NO:679) | 1842 | 2260 |
| HUMPHOSLIP_PEA_2_T19 (SEQ ID NO:680) | 1996 | 2414 |

Segment cluster HUMPHOSLIP_PEA_2_node_70 (SEQ ID NO: 685) according to the present invention is supported by 5 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 30 below describes the starting and ending position of this segment on each transcript.

TABLE 30

Segment location on transcripts

| Transcript name | Segment starting position | Segment ending position |
|---|---|---|
| HUMPHOSLIP_PEA_2_T6 (SEQ ID NO:674) | 2298 | 2529 |
| HUMPHOSLIP_PEA_2_T7 (SEQ ID NO:675) | 2436 | 2667 |
| HUMPHOSLIP_PEA_2_T14 (SEQ ID NO:676) | 2429 | 2660 |
| HUMPHOSLIP_PEA_2_T16 (SEQ ID NO:677) | 2337 | 2568 |
| HUMPHOSLIP_PEA_2_T17 (SEQ ID NO:678) | 2059 | 2290 |
| HUMPHOSLIP_PEA_2_T18 (SEQ ID NO:679) | 2273 | 2504 |
| HUMPHOSLIP_PEA_2_T19 (SEQ ID NO:680) | 2427 | 2658 |

Segment cluster HUMPHOSLIP_PEA_2_node_75 (SEQ ID NO: 686) according to the present invention is supported by 14 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 31 below describes the starting and ending position of this segment on each transcript.

TABLE 31

Segment location on transcripts

| Transcript name | Segment starting position | Segment ending position |
|---|---|---|
| HUMPHOSLIP_PEA_2_T6 (SEQ ID NO:674) | 2846 | 3125 |
| HUMPHOSLIP_PEA_2_T7 (SEQ ID NO:675) | 2984 | 3263 |
| HUMPHOSLIP_PEA_2_T14 (SEQ ID NO:676) | 2977 | 3256 |
| HUMPHOSLIP_PEA_2_T16 (SEQ ID NO:677) | 2885 | 3164 |
| HUMPHOSLIP_PEA_2_T17 (SEQ ID NO:678) | 2607 | 2886 |
| HUMPHOSLIP_PEA_2_T18 (SEQ ID NO:679) | 2821 | 3100 |
| HUMPHOSLIP_PEA_2_T19 (SEQ ID NO:680) | 2975 | 3254 |

According to an optional embodiment of the present invention, short segments related to the above cluster are also provided. These segments are up to about 120 bp in length, and so are included in a separate description.

Segment cluster HUMPHOSLIP_PEA_2_node_2 (SEQ ID NO: 687) according to the present invention is supported by 159 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 32 below describes the starting and ending position of this segment on each transcript.

TABLE 32

Segment location on transcripts

| Transcript name | Segment starting position | Segment ending position |
|---|---|---|
| HUMPHOSLIP_PEA_2_T6 (SEQ ID NO:674) | 265 | 337 |
| HUMPHOSLIP_PEA_2_T7 (SEQ ID NO:675) | 265 | 337 |
| HUMPHOSLIP_PEA_2_T14 (SEQ ID NO:676) | 265 | 337 |
| HUMPHOSLIP_PEA_2_T16 (SEQ ID NO:677) | 265 | 337 |
| HUMPHOSLIP_PEA_2_T17 (SEQ ID NO:678) | 265 | 337 |
| HUMPHOSLIP_PEA_2_T18 (SEQ ID NO:679) | 265 | 337 |
| HUMPHOSLIP_PEA_2_T19 (SEQ ID NO:680) | 265 | 337 |

Segment cluster HUMPHOSLIP_PEA_2_node_3 (SEQ ID NO: 688) according to the present invention can be found in the following transcript(s): HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 33 below describes the starting and ending position of this segment on each transcript.

TABLE 33

Segment location on transcripts

| Transcript name | Segment starting position | Segment ending position |
|---|---|---|
| HUMPHOSLIP_PEA_2_T7 (SEQ ID NO:675) | 338 | 355 |
| HUMPHOSLIP_PEA_2_T14 (SEQ ID NO:676) | 338 | 355 |
| HUMPHOSLIP_PEA_2_T16 (SEQ ID NO:677) | 338 | 355 |
| HUMPHOSLIP_PEA_2_T17 (SEQ ID NO:678) | 338 | 355 |
| HUMPHOSLIP_PEA_2_T18 (SEQ ID NO:679) | 338 | 355 |
| HUMPHOSLIP_PEA_2_T19 (SEQ ID NO:680) | 338 | 355 |

Segment cluster HUMPHOSLIP_PEA_2_node_4 (SEQ ID NO: 689) according to the present invention can be found in the following transcript(s): HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 34 below describes the starting and ending position of this segment on each transcript.

TABLE 34

Segment location on transcripts

| Transcript name | Segment starting position | Segment ending position |
|---|---|---|
| HUMPHOSLIP_PEA_2_T7 (SEQ ID NO:675) | 356 | 375 |
| HUMPHOSLIP_PEA_2_T14 (SEQ ID NO:676) | 356 | 375 |
| HUMPHOSLIP_PEA_2_T16 (SEQ ID NO:677) | 356 | 375 |
| HUMPHOSLIP_PEA_2_T17 (SEQ ID NO:678) | 356 | 375 |
| HUMPHOSLIP_PEA_2_T18 (SEQ ID NO:679) | 356 | 375 |
| HUMPHOSLIP_PEA_2_T19 (SEQ ID NO:680) | 356 | 375 |

Segment cluster HUMPHOSLIP_PEA_2_node_6 (SEQ ID NO: 690) according to the present invention can be found in the following transcript(s): HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 35 below describes the starting and ending position of this segment on each transcript.

TABLE 35

Segment location on transcripts

| Transcript name | Segment starting position | Segment ending position |
|---|---|---|
| HUMPHOSLIP_PEA_2_T7 (SEQ ID NO:675) | 376 | 383 |
| HUMPHOSLIP_PEA_2_T14 (SEQ ID NO:676) | 376 | 383 |
| HUMPHOSLIP_PEA_2_T16 (SEQ ID NO:677) | 376 | 383 |
| HUMPHOSLIP_PEA_2_T17 (SEQ ID NO:678) | 376 | 383 |
| HUMPHOSLIP_PEA_2_T18 (SEQ ID NO:679) | 376 | 383 |
| HUMPHOSLIP_PEA_2_T19 (SEQ ID NO:680) | 376 | 383 |

Segment cluster HUMPHOSLIP_PEA_2_node_7 (SEQ ID NO: 691) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 36 below describes the starting and ending position of this segment on each transcript.

TABLE 36

Segment location on transcripts

| Transcript name | Segment starting position | Segment ending position |
|---|---|---|
| HUMPHOSLIP_PEA_2_T6 (SEQ ID NO:674) | 338 | 343 |
| HUMPHOSLIP_PEA_2_T7 (SEQ ID NO:675) | 384 | 389 |
| HUMPHOSLIP_PEA_2_T14 (SEQ ID NO:676) | 384 | 389 |
| HUMPHOSLIP_PEA_2_T16 (SEQ ID NO:677) | 384 | 389 |
| HUMPHOSLIP_PEA_2_T17 (SEQ ID NO:678) | 384 | 389 |
| HUMPHOSLIP_PEA_2_T18 (SEQ ID NO:679) | 384 | 389 |
| HUMPHOSLIP_PEA_2_T19 (SEQ ID NO:680) | 384 | 389 |

Segment cluster HUMPHOSLIP_PEA_2_node_8 (SEQ ID NO: 692) according to the present invention is supported by 171 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 37 below describes the starting and ending position of this segment on each transcript.

TABLE 37

Segment location on transcripts

| Transcript name | Segment starting position | Segment ending position |
|---|---|---|
| HUMPHOSLIP_PEA_2_T6 (SEQ ID NO:674) | 344 | 378 |
| HUMPHOSLIP_PEA_2_T7 (SEQ ID NO:675) | 390 | 424 |
| HUMPHOSLIP_PEA_2_T14 (SEQ ID NO:676) | 390 | 424 |
| HUMPHOSLIP_PEA_2_T16 (SEQ ID NO:677) | 390 | 424 |
| HUMPHOSLIP_PEA_2_T17 (SEQ ID NO:678) | 390 | 424 |
| HUMPHOSLIP_PEA_2_T18 (SEQ ID NO:679) | 390 | 424 |
| HUMPHOSLIP_PEA_2_T19 (SEQ ID NO:680) | 390 | 424 |

Segment cluster HUMPHOSLIP_PEA_2_node_9 (SEQ ID NO: 693) according to the present invention is supported by 168 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 38 below describes the starting and ending position of this segment on each transcript.

TABLE 38

Segment location on transcripts

| Transcript name | Segment starting position | Segment ending position |
|---|---|---|
| HUMPHOSLIP_PEA_2_T6 (SEQ ID NO:674) | 379 | 429 |
| HUMPHOSLIP_PEA_2_T7 (SEQ ID NO:675) | 425 | 475 |
| HUMPHOSLIP_PEA_2_T14 (SEQ ID NO:676) | 425 | 475 |
| HUMPHOSLIP_PEA_2_T16 (SEQ ID NO:677) | 425 | 475 |
| HUMPHOSLIP_PEA_2_T17 (SEQ ID NO:678) | 425 | 475 |
| HUMPHOSLIP_PEA_2_T18 (SEQ ID NO:679) | 425 | 475 |
| HUMPHOSLIP_PEA_2_T19 (SEQ ID NO:680) | 425 | 475 |

Segment cluster HUMPHOSLIP_PEA_2_node_14 (SEQ ID NO: 694) according to the present invention is supported by 6 libraries. The number of libraries was determined as previously described. This segment can be found in the following transcript(s): HUMPHOSLIP_PEA_2_T7 (SEQ ID NO: 675). Table 39 below describes the starting and ending position of this segment on each transcript.

TABLE 39

Segment location on transcripts

| Transcript name | Segment starting position | Segment ending position |
|---|---|---|
| HUMPHOSLIP_PEA_2_T7 (SEQ ID NO: 675) | 476 | 567 |

Segment cluster HUMPHOSLIP_PEA_2_node_15 (SEQ ID NO: 695) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T18 (SEQ ID NO: 679) and HUMPHOSLIP_PEA_2_T19 (SEQ ID NO: 680). Table 40 below describes the starting and ending position of this segment on each transcript.

TABLE 40

Segment location on transcripts

| Transcript name | Segment starting position | Segment ending position |
|---|---|---|
| HUMPHOSLIP_PEA_2_T6 (SEQ ID NO: 674) | 430 | 445 |
| HUMPHOSLIP_PEA_2_T7 (SEQ ID NO: 675) | 568 | 583 |
| HUMPHOSLIP_PEA_2_T14 (SEQ ID NO: 676) | 476 | 491 |
| HUMPHOSLIP_PEA_2_T16 (SEQ ID NO: 677) | 476 | 491 |
| HUMPHOSLIP_PEA_2_T18 (SEQ ID NO: 679) | 476 | 491 |
| HUMPHOSLIP_PEA_2_T19 (SEQ ID NO: 680) | 476 | 491 |

Segment cluster HUMPHOSLIP_PEA_2_node_16 (SEQ ID NO: 696) according to the present invention is supported by 179 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T18 (SEQ ID NO: 679) and HUMPHOSLIP_PEA_2_T19 (SEQ ID NO: 680). Table 41 below describes the starting and ending position of this segment on each transcript.

TABLE 41

Segment location on transcripts

| Transcript name | Segment starting position | Segment ending position |
|---|---|---|
| HUMPHOSLIP_PEA_2_T6 (SEQ ID NO: 674) | 446 | 534 |
| HUMPHOSLIP_PEA_2_T7 (SEQ ID NO: 675) | 584 | 672 |
| HUMPHOSLIP_PEA_2_T14 (SEQ ID NO: 676) | 492 | 580 |
| HUMPHOSLIP_PEA_2_T16 (SEQ ID NO: 677) | 492 | 580 |
| HUMPHOSLIP_PEA_2_T18 (SEQ ID NO: 679) | 492 | 580 |
| HUMPHOSLIP_PEA_2_T19 (SEQ ID NO: 680) | 492 | 580 |

Segment cluster HUMPHOSLIP_PEA_2_node_17 (SEQ ID NO: 697) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T18 (SEQ ID NO: 679) and HUMPHOSLIP_PEA_2_T19 (SEQ ID NO: 680). Table 42 below describes the starting and ending position of this segment on each transcript.

TABLE 42

Segment location on transcripts

| Transcript name | Segment starting position | Segment ending position |
|---|---|---|
| HUMPHOSLIP_PEA_2_T6 (SEQ ID NO: 674) | 535 | 558 |
| HUMPHOSLIP_PEA_2_T7 (SEQ ID NO: 675) | 673 | 696 |
| HUMPHOSLIP_PEA_2_T14 (SEQ ID NO: 676) | 581 | 604 |
| HUMPHOSLIP_PEA_2_T16 (SEQ ID NO: 677) | 581 | 604 |
| HUMPHOSLIP_PEA_2_T18 (SEQ ID NO: 679) | 581 | 604 |
| HUMPHOSLIP_PEA_2_T19 (SEQ ID NO: 680) | 581 | 604 |

Segment cluster HUMPHOSLIP_PEA_2_node_23 (SEQ ID NO: 698) according to the present invention is supported by 168 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 43 below describes the starting and ending position of this segment on each transcript.

TABLE 43

Segment location on transcripts

| Transcript name | Segment starting position | Segment ending position |
|---|---|---|
| HUMPHOSLIP_PEA_2_T6 (SEQ ID NO: 674) | 715 | 766 |
| HUMPHOSLIP_PEA_2_T7 (SEQ ID NO: 675) | 853 | 904 |
| HUMPHOSLIP_PEA_2_T14 (SEQ ID NO: 676) | 761 | 812 |
| HUMPHOSLIP_PEA_2_T16 (SEQ ID NO: 677) | 761 | 812 |
| HUMPHOSLIP_PEA_2_T17 (SEQ ID NO: 678) | 476 | 527 |
| HUMPHOSLIP_PEA_2_T18 (SEQ ID NO: 679) | 605 | 656 |
| HUMPHOSLIP_PEA_2_T19 (SEQ ID NO: 680) | 761 | 812 |

Segment cluster HUMPHOSLIP_PEA_2_node_24 (SEQ ID NO: 699) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 44 below describes the starting and ending position of this segment on each transcript.

TABLE 44

Segment location on transcripts

| Transcript name | Segment starting position | Segment ending position |
|---|---|---|
| HUMPHOSLIP_PEA_2_T6 (SEQ ID NO: 674) | 767 | 778 |
| HUMPHOSLIP_PEA_2_T7 (SEQ ID NO: 675) | 905 | 916 |
| HUMPHOSLIP_PEA_2_T14 (SEQ ID NO: 676) | 813 | 824 |
| HUMPHOSLIP_PEA_2_T16 (SEQ ID NO: 677) | 813 | 824 |
| HUMPHOSLIP_PEA_2_T17 (SEQ ID NO: 678) | 528 | 539 |
| HUMPHOSLIP_PEA_2_T18 (SEQ ID NO: 679) | 657 | 668 |
| HUMPHOSLIP_PEA_2_T19 (SEQ ID NO: 680) | 813 | 824 |

Segment cluster HUMPHOSLIP_PEA_2_node_25 (SEQ ID NO: 700) according to the present invention is supported by 5 libraries. The number of libraries was determined as previously described. This segment can be found in the following transcript(s): HUMPHOSLIP_PEA_2_T14 (SEQ ID NO: 676) and HUMPHOSLIP_PEA_2_T18 (SEQ ID NO: 679). Table 45 below describes the starting and ending position of this segment on each transcript.

TABLE 45

Segment location on transcripts

| Transcript name | Segment starting position | Segment ending position |
|---|---|---|
| HUMPHOSLIP_PEA_2_T14 (SEQ ID NO: 676) | 825 | 909 |
| HUMPHOSLIP_PEA_2_T18 (SEQ ID NO: 679) | 669 | 753 |

Segment cluster HUMPHOSLIP_PEA_2_node_26 (SEQ ID NO: 701) according to the present invention is supported by 163 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 46 below describes the starting and ending position of this segment on each transcript.

TABLE 46

Segment location on transcripts

| Transcript name | Segment starting position | Segment ending position |
|---|---|---|
| HUMPHOSLIP_PEA_2_T6 (SEQ ID NO: 674) | 779 | 842 |
| HUMPHOSLIP_PEA_2_T7 (SEQ ID NO: 675) | 917 | 980 |
| HUMPHOSLIP_PEA_2_T14 (SEQ ID NO: 676) | 910 | 973 |
| HUMPHOSLIP_PEA_2_T16 (SEQ ID NO: 677) | 825 | 888 |
| HUMPHOSLIP_PEA_2_TI7 (SEQ ID NO: 678) | 540 | 603 |
| HUMPHOSLIP_PEA_2_T18 (SEQ ID NO: 679) | 754 | 817 |
| HUMPHOSLIP_PEA_2_T19 (SEQ ID NO: 680) | 825 | 888 |

Segment cluster HUMPHOSLIP_PEA_2_node_29 (SEQ ID NO: 702) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 47 below describes the starting and ending position of this segment on each transcript.

TABLE 47

Segment location on transcripts

| Transcript name | Segment starting position | Segment ending position |
|---|---|---|
| HUMPHOSLIP_PEA_2_T6 (SEQ ID NO: 674) | 843 | 849 |
| HUMPHOSLIP_PEA_2_T7 (SEQ ID NO: 675) | 981 | 987 |
| HUMPHOSLIP_PEA_2_T14 (SEQ ID NO: 676) | 974 | 980 |
| HUMPHOSLIP_PEA_2_T17 (SEQ ID NO: 678) | 604 | 610 |
| HUMPHOSLIP_PEA_2_T18 (SEQ ID NO: 679) | 818 | 824 |
| HUMPHOSLIP_PEA_2_T19 (SEQ ID NO: 680) | 889 | 895 |

Segment cluster HUMPHOSLIP_PEA_2_node_30 (SEQ ID NO: 703) according to the present invention is supported by 181 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 48 below describes the starting and ending position of this segment on each transcript.

TABLE 48

Segment location on transcripts

| Transcript name | Segment starting position | Segment ending position |
|---|---|---|
| HUMPHOSLIP_PEA_2_T6 (SEQ ID NO: 674) | 850 | 934 |

TABLE 48-continued

Segment location on transcripts

| Transcript name | Segment starting position | Segment ending position |
|---|---|---|
| HUMPHOSLIP_PEA_2_T7 (SEQ ID NO: 675) | 988 | 1072 |
| HUMPHOSLIP_PEA_2_T14 (SEQ ID NO: 676) | 981 | 1065 |
| HUMPHOSLIP_PEA_2_T16 (SEQ ID NO: 677) | 889 | 973 |
| HUMPHOSLIP_PEA_2_T17 (SEQ ID NO: 678) | 611 | 695 |
| HUMPHOSLIP_PEA_2_T18 (SEQ ID NO: 679) | 825 | 909 |
| HUMPHOSLIP_PEA_2_T19 (SEQ ID NO: 680) | 896 | 980 |

Segment cluster HUMPHOSLIP_PEA_2_node_33 (SEQ ID NO: 704) according to the present invention is supported by 173 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 49 below describes the starting and ending position of this segment on each transcript.

TABLE 49

Segment location on transcripts

| Transcript name | Segment starting position | Segment ending position |
|---|---|---|
| HUMPHOSLIP_PEA_2_T6 (SEQ ID NO: 674) | 935 | 970 |
| HUMPHOSLIP_PEA_2_T7 (SEQ ID NO: 675) | 1073 | 1108 |
| HUMPHOSLIP_PEA_2_T14 (SEQ ID NO: 676) | 1066 | 1101 |
| HUMPHOSLIP_PEA_2_T16 (SEQ ID NO: 677) | 974 | 1009 |
| HUMPHOSLIP_PEA_2_T17 (SEQ ID NO: 678) | 696 | 731 |
| HUMPHOSLIP_PEA_2_T18 (SEQ ID NO: 679) | 910 | 945 |
| HUMPHOSLIP_PEA_2_T19 (SEQ ID NO: 680) | 981 | 1016 |

Segment cluster HUMPHOSLIP_PEA_2_node_36 (SEQ ID NO: 705) according to the present invention is supported by 163 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 50 below describes the starting and ending position of this segment on each transcript.

TABLE 50

Segment location on transcripts

| Transcript name | Segment starting position | Segment ending position |
|---|---|---|
| HUMPHOSLIP_PEA_2_T6 (SEQ ID NO: 674) | 1112 | 1156 |
| HUMPHOSLIP_PEA_2_T7 (SEQ ID NO: 675) | 1250 | 1294 |
| HUMPHOSLIP_PEA_2_T14 (SEQ ID NO: 676) | 1243 | 1287 |
| HUMPHOSLIP_PEA_2_T16 (SEQ ID NO: 677) | 1151 | 1195 |
| HUMPHOSLIP_PEA_2_T17 (SEQ ID NO: 678) | 873 | 917 |
| HUMPHOSLIP_PEA_2_T18 (SEQ ID NO: 679) | 1087 | 1131 |
| HUMPHOSLIP_PEA_2_T19 (SEQ ID NO: 680) | 1158 | 1202 |

Segment cluster HUMPHOSLIP_PEA_2_node_37 (SEQ ID NO: 706) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 51 below describes the starting and ending position of this segment on each transcript.

TABLE 51

Segment location on transcripts

| Transcript name | Segment starting position | Segment ending position |
|---|---|---|
| HUMPHOSLIP_PEA_2_T6 (SEQ ID NO: 674) | 1157 | 1171 |
| HUMPHOSLIP_PEA_2_T7 (SEQ ID NO: 675) | 1295 | 1309 |
| HUMPHOSLIP_PEA_2_T14 (SEQ ID NO: 676) | 1288 | 1302 |
| HUMPHOSLIP_PEA_2_T16 (SEQ ID NO: 677) | 1196 | 1210 |
| HUMPHOSLIP_PEA_2_T17 (SEQ ID NO: 678) | 918 | 932 |
| HUMPHOSLIP_PEA_2_T18 (SEQ ID NO: 679) | 1132 | 1146 |
| HUMPHOSLIP_PEA_2_T19 (SEQ ID NO: 680) | 1203 | 1217 |

Segment cluster HUMPHOSLIP_PEA_2_node_39 (SEQ ID NO: 707) according to the present invention is supported by 166 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 52 below describes the starting and ending position of this segment on each transcript.

TABLE 52

Segment location on transcripts

| Transcript name | Segment starting position | Segment ending position |
|---|---|---|
| HUMPHOSLIP_PEA_2_T6 (SEQ ID NO: 674) | 1172 | 1201 |
| HUMPHOSLIP_PEA_2_T7 (SEQ ID NO: 675) | 1310 | 1339 |
| HUMPHOSLIP_PEA_2_T14 (SEQ ID NO: 676) | 1303 | 1332 |
| HUMPHOSLIP_PEA_2_T16 (SEQ ID NO: 677) | 1211 | 1240 |
| HUMPHOSLIP_PEA_2_T17 (SEQ ID NO: 678) | 933 | 962 |
| HUMPHOSLIP_PEA_2_T18 (SEQ ID NO: 679) | 1147 | 1176 |
| HUMPHOSLIP_PEA_2_T19 (SEQ ID NO: 680) | 1218 | 1247 |

Segment cluster HUMPHOSLIP_PEA_2_node_40 (SEQ ID NO: 708) according to the present invention is supported by 199 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 53 below describes the starting and ending position of this segment on each transcript.

TABLE 53

Segment location on transcripts

| Transcript name | Segment starting position | Segment ending position |
|---|---|---|
| HUMPHOSLIP_PEA_2_T6 (SEQ ID NO: 674) | 1202 | 1288 |
| HUMPHOSLIP_PEA_2_T7 (SEQ ID NO: 675) | 1340 | 1426 |
| HUMPHOSLIP_PEA_2_T14 (SEQ ID NO: 676) | 1333 | 1419 |
| HUMPHOSLIP_PEA_2_T16 (SEQ ID NO: 677) | 1241 | 1327 |
| HUMPHOSLIP_PEA_2_T17 (SEQ ID NO: 678) | 963 | 1049 |
| HUMPHOSLIP_PEA_2_T18 (SEQ ID NO: 679) | 1177 | 1263 |
| HUMPHOSLIP_PEA_2_T19 (SEQ ID NO: 680) | 1248 | 1334 |

Segment cluster HUMPHOSLIP_PEA_2_node_41 (SEQ ID NO: 709) according to the present invention is supported by 186 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 54 below describes the starting and ending position of this segment on each transcript.

TABLE 54

Segment location on transcripts

| Transcript name | Segment starting position | Segment ending position |
|---|---|---|
| HUMPHOSLIP_PEA_2_T6 (SEQ ID NO: 674) | 1289 | 1318 |
| HUMPHOSLIP_PEA_2_T7 (SEQ ID NO: 675) | 1427 | 1456 |
| HUMPHOSLIP_PEA_2_T14 (SEQ ID NO: 676) | 1420 | 1449 |
| HUMPHOSLIP_PEA_2_T16 (SEQ ID NO: 677) | 1328 | 1357 |
| HUMPHOSLIP_PEA_2_T17 (SEQ ID NO: 678) | 1050 | 1079 |
| HUMPHOSLIP_PEA_2_T18 (SEQ ID NO: 679) | 1264 | 1293 |
| HUMPHOSLIP_PEA_2_T19 (SEQ ID NO: 680) | 1335 | 1364 |

Segment cluster HUMPHOSLIP_PEA_2_node_42 (SEQ ID NO: 710) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 55 below describes the starting and ending position of this segment on each transcript.

TABLE 55

Segment location on transcripts

| Transcript name | Segment starting position | Segment ending position |
|---|---|---|
| HUMPHOSLIP_PEA_2_T6 (SEQ ID NO: 674) | 1319 | 1336 |
| HUMPHOSLIP_PEA_2_T7 (SEQ ID NO: 675) | 1457 | 1474 |
| HUMPHOSLIP_PEA_2_T14 (SEQ ID NO: 676) | 1450 | 1467 |
| HUMPHOSLIP_PEA_2_T16 (SEQ ID NO: 677) | 1358 | 1375 |
| HUMPHOSLIP_PEA_2_T17 (SEQ ID NO: 678) | 1080 | 1097 |
| HUMPHOSLIP_PEA_2_T18 (SEQ ID NO: 679) | 1294 | 1311 |
| HUMPHOSLIP_PEA_2_T19 (SEQ ID NO: 680) | 1365 | 1382 |

Segment cluster HUMPHOSLIP_PEA_2_node_44 (SEQ ID NO: 711) according to the present invention is supported by 185 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 56 below describes the starting and ending position of this segment on each transcript.

TABLE 56

Segment location on transcripts

| Transcript name | Segment starting position | Segment ending position |
|---|---|---|
| HUMPHOSLIP_PEA_2_T6 (SEQ ID NO: 674) | 1337 | 1363 |
| HUMPHOSLIP_PEA_2_T7 (SEQ ID NO: 675) | 1475 | 1501 |
| HUMPHOSLIP_PEA_2_T14 (SEQ ID NO: 676) | 1468 | 1494 |
| HUMPHOSLIP_PEA_2_T16 (SEQ ID NO: 677) | 1376 | 1402 |
| HUMPHOSLIP_PEA_2_T17 (SEQ ID NO: 678) | 1098 | 1124 |
| HUMPHOSLIP_PEA_2_T18 (SEQ ID NO: 679) | 1312 | 1338 |
| HUMPHOSLIP_PEA_2_T19 (SEQ ID NO: 680) | 1383 | 1409 |

Segment cluster HUMPHOSLIP_PEA_2_node_45 (SEQ ID NO: 712) according to the present invention is supported by 197 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 57 below describes the starting and ending position of this segment on each transcript.

TABLE 57

Segment location on transcripts

| Transcript name | Segment starting position | Segment ending position |
|---|---|---|
| HUMPHOSLIP_PEA_2_T6 (SEQ ID NO: 674) | 1364 | 1404 |
| HUMPHOSLIP_PEA_2_T7 (SEQ ID NO: 675) | 1502 | 1542 |
| HUMPHOSLIP_PEA_2_T14 (SEQ ID NO: 676) | 1495 | 1535 |
| HUMPHOSLIP_PEA_2_T16 (SEQ ID NO: 677) | 1403 | 1443 |
| HUMPHOSLIP_PEA_2_T17 (SEQ ID NO: 678) | 1125 | 1165 |
| HUMPHOSLIP_PEA_2_T18 (SEQ ID NO: 679) | 1339 | 1379 |
| HUMPHOSLIP_PEA_2_T19 (SEQ ID NO: 680) | 1410 | 1450 |

Segment cluster HUMPHOSLIP_PEA_2_node_47 (SEQ ID NO: 713) according to the present invention is supported by 223 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 58 below describes the starting and ending position of this segment on each transcript.

TABLE 58

Segment location on transcripts

| Transcript name | Segment starting position | Segment ending position |
|---|---|---|
| HUMPHOSLIP_PEA_2_T6 (SEQ ID NO: 674) | 1405 | 1447 |
| HUMPHOSLIP_PEA_2_T7 (SEQ ID NO: 675) | 1543 | 1585 |
| HUMPHOSLIP_PEA_2_T14 (SEQ ID NO: 676) | 1536 | 1578 |
| HUMPHOSLIP_PEA_2_T16 (SEQ ID NO: 677) | 1444 | 1486 |
| HUMPHOSLIP_PEA_2_T17 (SEQ ID NO: 678) | 1166 | 1208 |
| HUMPHOSLIP_PEA_2_T18 (SEQ ID NO: 679) | 1380 | 1422 |
| HUMPHOSLIP_PEA_2_T19 (SEQ ID NO: 680) | 1451 | 1493 |

Segment cluster HUMPHOSLIP_PEA_2_node_51 (SEQ ID NO: 714) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 59 below describes the starting and ending position of this segment on each transcript.

TABLE 59

Segment location on transcripts

| Transcript name | Segment starting position | Segment ending position |
|---|---|---|
| HUMPHOSLIP_PEA_2_T6 (SEQ ID NO: 674) | 1448 | 1462 |
| HUMPHOSLIP_PEA_2_T7 (SEQ ID NO: 675) | 1586 | 1600 |
| HUMPHOSLIP_PEA_2_T14 (SEQ ID NO: 676) | 1579 | 1593 |
| HUMPHOSLIP_PEA_2_T16 (SEQ ID NO: 677) | 1487 | 1501 |
| HUMPHOSLIP_PEA_2_T17 (SEQ ID NO: 678) | 1209 | 1223 |
| HUMPHOSLIP_PEA_2_T18 (SEQ ID NO: 679) | 1423 | 1437 |
| HUMPHOSLIP_PEA_2_T19 (SEQ ID NO: 680) | 1494 | 1508 |

Segment cluster HUMPHOSLIP_PEA_2_node_52 (SEQ ID NO: 715) according to the present invention is supported by 235 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 60 below describes the starting and ending position of this segment on each transcript.

TABLE 60

Segment location on transcripts

| Transcript name | Segment starting position | Segment ending position |
|---|---|---|
| HUMPHOSLIP_PEA_2_T6 (SEQ ID NO: 674) | 1463 | 1511 |
| HUMPHOSLIP_PEA_2_T7 (SEQ ID NO: 675) | 1601 | 1649 |
| HUMPHOSLIP_PEA_2_T14 (SEQ ID NO: 676) | 1594 | 1642 |
| HUMPHOSLIP_PEA_2_T16 (SEQ ID NO: 677) | 1502 | 1550 |
| HUMPHOSLIP_PEA_2_T17 (SEQ ID NO: 678) | 1224 | 1272 |
| HUMPHOSLIP_PEA_2_T18 (SEQ ID NO: 679) | 1438 | 1486 |
| HUMPHOSLIP_PEA_2_T19 (SEQ ID NO: 680) | 1509 | 1557 |

Segment cluster HUMPHOSLIP_PEA_2_node_53 (SEQ ID NO: 716) according to the present invention is supported by 5 libraries. The number of libraries was determined as previously described. This segment can be found in the following transcript(s): HUMPHOSLIP_PEA_2_T19 (SEQ ID NO: 680). Table 61 below describes the starting and ending position of this segment on each transcript.

TABLE 61

Segment location on transcripts

| Transcript name | Segment starting position | Segment ending position |
|---|---|---|
| HUMPHOSLIP_PEA_2_T19 (SEQ ID NO: 680) | 1558 | 1640 |

Segment cluster HUMPHOSLIP_PEA_2_node_54 (SEQ ID NO: 717) according to the present invention is supported by 236 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 62 below describes the starting and ending position of this segment on each transcript.

TABLE 62

Segment location on transcripts

| Transcript name | Segment starting position | Segment ending position |
|---|---|---|
| HUMPHOSLIP_PEA_2_T6 (SEQ ID NO: 674) | 1512 | 1552 |
| HUMPHOSLIP_PEA_2_T7 (SEQ ID NO: 675) | 1650 | 1690 |
| HUMPHOSLIP_PEA_2_T14 (SEQ ID NO: 676) | 1643 | 1683 |
| HUMPHOSLIP_PEA_2_T16 (SEQ ID NO: 677) | 1551 | 1591 |
| HUMPHOSLIP_PEA_2_T17 (SEQ ID NO: 678) | 1273 | 1313 |
| HUMPHOSLIP_PEA_2_T18 (SEQ ID NO: 679) | 1487 | 1527 |
| HUMPHOSLIP_PEA_2_T19 (SEQ ID NO: 680) | 1641 | 1681 |

Segment cluster HUMPHOSLIP_PEA_2_node_55 (SEQ ID NO: 718) according to the present invention is supported by 232 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 63 below describes the starting and ending position of this segment on each transcript.

TABLE 63

Segment location on transcripts

| Transcript name | Segment starting position | Segment ending position |
|---|---|---|
| HUMPHOSLIP_PEA_2_T6 (SEQ ID NO: 674) | 1553 | 1588 |
| HUMPHOSLIP_PEA_2_T7 (SEQ ID NO: 675) | 1691 | 1726 |
| HUMPHOSLIP_PEA_2_T14 (SEQ ID NO: 676) | 1684 | 1719 |
| HUMPHOSLIP_PEA_2_T16 (SEQ ID NO: 677) | 1592 | 1627 |
| HUMPHOSLIP_PEA_2_T17 (SEQ ID NO: 678) | 1314 | 1349 |
| HUMPHOSLIP_PEA_2_T18 (SEQ ID NO: 679) | 1528 | 1563 |
| HUMPHOSLIP_PEA_2_T19 (SEQ ID NO: 680) | 1682 | 1717 |

Segment cluster HUMPHOSLIP_PEA_2_node_58 (SEQ ID NO: 719) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 64 below describes the starting and ending position of this segment on each transcript.

TABLE 64

Segment location on transcripts

| Transcript name | Segment starting position | Segment ending position |
|---|---|---|
| HUMPHOSLIP_PEA_2_T6 (SEQ ID NO: 674) | 1589 | 1612 |

TABLE 64-continued

Segment location on transcripts

| Transcript name | Segment starting position | Segment ending position |
|---|---|---|
| HUMPHOSLIP_PEA_2_T7 (SEQ ID NO: 675) | 1727 | 1750 |
| HUMPHOSLIP_PEA_2_T14 (SEQ ID NO: 676) | 1720 | 1743 |
| HUMPHOSLIP_PEA_2_T16 (SEQ ID NO: 677) | 1628 | 1651 |
| HUMPHOSLIP_PEA_2_T17 (SEQ ID NO: 678) | 1350 | 1373 |
| HUMPHOSLIP_PEA_2_T18 (SEQ ID NO: 679) | 1564 | 1587 |
| HUMPHOSLIP_PEA_2_T19 (SEQ ID NO: 680) | 1718 | 1741 |

Segment cluster HUMPHOSLIP_PEA_2_node_59 (SEQ ID NO: 720) according to the present invention is supported by 230 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 65 below describes the starting and ending position of this segment on each transcript.

TABLE 65

Segment location on transcripts

| Transcript name | Segment starting position | Segment ending position |
|---|---|---|
| HUMPHOSLIP_PEA_2_T6 (SEQ ID NO: 674) | 1613 | 1648 |
| HUMPHOSLIP_PEA_2_T7 (SEQ ID NO: 675) | 1751 | 1786 |
| HUMPHOSLIP_PEA_2_T14 (SEQ ID NO: 676) | 1744 | 1779 |
| HUMPHOSLIP_PEA_2_T16 (SEQ ID NO: 677) | 1652 | 1687 |
| HUMPHOSLIP_PEA_2_T17 (SEQ ID NO: 678) | 1374 | 1409 |
| HUMPHOSLIP_PEA_2_T18 (SEQ ID NO: 679) | 1588 | 1623 |
| HUMPHOSLIP_PEA_2_T19 (SEQ ID NO: 680) | 1742 | 1777 |

Segment cluster HUMPHOSLIP_PEA_2_node_60 (SEQ ID NO: 721) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 66 below describes the starting and ending position of this segment on each transcript.

TABLE 66

Segment location on transcripts

| Transcript name | Segment starting position | Segment ending position |
|---|---|---|
| HUMPHOSLIP_PEA_2_T6 (SEQ ID NO: 674) | 1649 | 1671 |
| HUMPHOSLIP_PEA_2_T7 (SEQ ID NO: 675) | 1787 | 1809 |
| HUMPHOSLIP_PEA_2_T14 (SEQ ID NO: 676) | 1780 | 1802 |
| HUMPHOSLIP_PEA_2_T16 (SEQ ID NO: 677) | 1688 | 1710 |
| HUMPHOSLIP_PEA_2_T17 (SEQ ID NO: 678) | 1410 | 1432 |
| HUMPHOSLIP_PEA_2_T18 (SEQ ID NO: 679) | 1624 | 1646 |
| HUMPHOSLIP_PEA_2_T19 (SEQ ID NO: 680) | 1778 | 1800 |

Segment cluster HUMPHOSLIP_PEA_2_node_61 (SEQ ID NO: 722) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 67 below describes the starting and ending position of this segment on each transcript.

TABLE 67

Segment location on transcripts

| Transcript name | Segment starting position | Segment ending position |
|---|---|---|
| HUMPHOSLIP_PEA_2_T6 (SEQ ID NO: 674) | 1672 | 1680 |
| HUMPHOSLIP_PEA_2_T7 (SEQ ID NO: 675) | 1810 | 1818 |
| HUMPHOSLIP_PEA_2_T14 (SEQ ID NO: 676) | 1803 | 1811 |
| HUMPHOSLIP_PEA_2_T16 (SEQ ID NO: 677) | 1711 | 1719 |
| HUMPHOSLIP_PEA_2_T17 (SEQ ID NO: 678) | 1433 | 1441 |
| HUMPHOSLIP_PEA_2_T18 (SEQ ID NO: 679) | 1647 | 1655 |
| HUMPHOSLIP_PEA_2_T19 (SEQ ID NO: 680) | 1801 | 1809 |

Segment cluster HUMPHOSLIP_PEA_2_node_62 (SEQ ID NO: 723) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 68 below describes the starting and ending position of this segment on each transcript.

TABLE 68

Segment location on transcripts

| Transcript name | Segment starting position | Segment ending position |
|---|---|---|
| HUMPHOSLIP_PEA_2_T6 (SEQ ID NO: 674) | 1681 | 1703 |
| HUMPHOSLIP_PEA_2_T7 (SEQ ID NO: 675) | 1819 | 1841 |
| HUMPHOSLIP_PEA_2_T14 (SEQ ID NO: 676) | 1812 | 1834 |
| HUMPHOSLIP_PEA_2_T16 (SEQ ID NO: 677) | 1720 | 1742 |
| HUMPHOSLIP_PEA_2_T17 (SEQ ID NO: 678) | 1442 | 1464 |
| HUMPHOSLIP_PEA_2_T18 (SEQ ID NO: 679) | 1656 | 1678 |
| HUMPHOSLIP_PEA_2_T19 (SEQ ID NO: 680) | 1810 | 1832 |

Segment cluster HUMPHOSLIP_PEA_2_node_63 (SEQ ID NO: 724) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 69 below describes the starting and ending position of this segment on each transcript.

TABLE 69

Segment location on transcripts

| Transcript name | Segment starting position | Segment ending position |
|---|---|---|
| HUMPHOSLIP_PEA_2_T6 (SEQ ID NO: 674) | 1704 | 1727 |
| HUMPHOSLIP_PEA_2_T7 (SEQ ID NO: 675) | 1842 | 1865 |
| HUMPHOSLIP_PEA_2_T14 (SEQ ID NO: 676) | 1835 | 1858 |
| HUMPHOSLIP_PEA_2_T16 (SEQ ID NO: 677) | 1743 | 1766 |
| HUMPHOSLIP_PEA_2_T17 (SEQ ID NO: 678) | 1465 | 1488 |
| HUMPHOSLIP_PEA_2_T18 (SEQ ID NO: 679) | 1679 | 1702 |
| HUMPHOSLIP_PEA_2_T19 (SEQ ID NO: 680) | 1833 | 1856 |

Segment cluster HUMPHOSLIP_PEA_2_node_64 (SEQ ID NO: 725) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 70 below describes the starting and ending position of this segment on each transcript.

TABLE 70

Segment location on transcripts

| Transcript name | Segment starting position | Segment ending position |
|---|---|---|
| HUMPHOSLIP_PEA_2_T6 (SEQ ID NO: 674) | 1728 | 1734 |
| HUMPHOSLIP_PEA_2_T7 (SEQ ID NO: 675) | 1866 | 1872 |
| HUMPHOSLIP_PEA_2_T14 (SEQ ID NO: 676) | 1859 | 1865 |
| HUMPHOSLIP_PEA_2_T16 (SEQ ID NO: 677) | 1767 | 1773 |
| HUMPHOSLIP_PEA_2_T17 (SEQ ID NO: 678) | 1489 | 1495 |
| HUMPHOSLIP_PEA_2_T18 (SEQ ID NO: 679) | 1703 | 1709 |
| HUMPHOSLIP_PEA_2_T19 (SEQ ID NO: 680) | 1857 | 1863 |

Segment cluster HUMPHOSLIP_PEA_2_node_65 (SEQ ID NO: 726) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 71 below describes the starting and ending position of this segment on each transcript.

TABLE 71

Segment location on transcripts

| Transcript name | Segment starting position | Segment ending position |
|---|---|---|
| HUMPHOSLIP_PEA_2_T6 (SEQ ID NO: 674) | 1735 | 1754 |
| HUMPHOSLIP_PEA_2_T7 (SEQ ID NO: 675) | 1873 | 1892 |
| HUMPHOSLIP_PEA_2_T14 (SEQ ID NO: 676) | 1866 | 1885 |
| HUMPHOSLIP_PEA_2_T16 (SEQ ID NO: 677) | 1774 | 1793 |
| HUMPHOSLIP_PEA_2_T17 (SEQ ID NO: 678) | 1496 | 1515 |
| HUMPHOSLIP_PEA_2_T18 (SEQ ID NO: 679) | 1710 | 1729 |
| HUMPHOSLIP_PEA_2_T19 (SEQ ID NO: 680) | 1864 | 1883 |

Segment cluster HUMPHOSLIP_PEA_2_node_66 (SEQ ID NO: 727) according to the present invention is supported by 180 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 72 below describes the starting and ending position of this segment on each transcript.

TABLE 72

Segment location on transcripts

| Transcript name | Segment starting position | Segment ending position |
|---|---|---|
| HUMPHOSLIP_PEA_2_T6 (SEQ ID NO: 674) | 1755 | 1844 |
| HUMPHOSLIP_PEA_2_T7 (SEQ ID NO: 675) | 1893 | 1982 |
| HUMPHOSLIP_PEA_2_T14 (SEQ ID NO: 676) | 1886 | 1975 |
| HUMPHOSLIP_PEA_2_T16 (SEQ ID NO: 677) | 1794 | 1883 |
| HUMPHOSLIP_PEA_2_T17 (SEQ ID NO: 678) | 1516 | 1605 |
| HUMPHOSLIP_PEA_2_T18 (SEQ ID NO: 679) | 1730 | 1819 |
| HUMPHOSLIP_PEA_2_T19 (SEQ ID NO: 680) | 1884 | 1973 |

Segment cluster HUMPHOSLIP_PEA_2_node_67 (SEQ ID NO: 728) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 73 below describes the starting and ending position of this segment on each transcript.

TABLE 73

Segment location on transcripts

| Transcript name | Segment starting position | Segment ending position |
|---|---|---|
| HUMPHOSLIP_PEA_2_T6 (SEQ ID NO: 674) | 1845 | 1866 |
| HUMPHOSLIP_PEA_2_T7 (SEQ ID NO: 675) | 1983 | 2004 |
| HUMPHOSLIP_PEA_2_T14 (SEQ ID NO: 676) | 1976 | 1997 |
| HUMPHOSLIP_PEA_2_T16 (SEQ ID NO: 677) | 1884 | 1905 |
| HUMPHOSLIP_PEA_2_T17 (SEQ ID NO: 678) | 1606 | 1627 |
| HUMPHOSLIP_PEA_2_T18 (SEQ ID NO: 679) | 1820 | 1841 |
| HUMPHOSLIP_PEA_2_T19 (SEQ ID NO: 680) | 1974 | 1995 |

Segment cluster HUMPHOSLIP_PEA_2_node_69 (SEQ ID NO: 729) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 74 below describes the starting and ending position of this segment on each transcript.

TABLE 74

Segment location on transcripts

| Transcript name | Segment starting position | Segment ending position |
|---|---|---|
| HUMPHOSLIP_PEA_2_T6 (SEQ ID NO: 674) | 2286 | 2297 |
| HUMPHOSLIP_PEA_2_T7 (SEQ ID NO: 675) | 2424 | 2435 |
| HUMPHOSLIP_PEA_2_T14 (SEQ ID NO: 676) | 2417 | 2428 |
| HUMPHOSLIP_PEA_2_T16 (SEQ ID NO: 677) | 2325 | 2336 |
| HUMPHOSLIP_PEA_2_T17 (SEQ ID NO: 678) | 2047 | 2058 |
| HUMPHOSLIP_PEA_2_T18 (SEQ ID NO: 679) | 2261 | 2272 |
| HUMPHOSLIP_PEA_2_T19 (SEQ ID NO: 680) | 2415 | 2426 |

Segment cluster HUMPHOSLIP_PEA_2_node_71 (SEQ ID NO: 730) according to the present invention can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 75 below describes the starting and ending position of this segment on each transcript.

TABLE 75

Segment location on transcripts

| Transcript name | Segment starting position | Segment ending position |
|---|---|---|
| HUMPHOSLIP_PEA_2_T6 (SEQ ID NO: 674) | 2530 | 2542 |
| HUMPHOSLIP_PEA_2_T7 (SEQ ID NO: 675) | 2668 | 2680 |
| HUMPHOSLIP_PEA_2_T14 (SEQ ID NO: 676) | 2661 | 2673 |
| HUMPHOSLIP_PEA_2_T16 (SEQ ID NO: 677) | 2569 | 2581 |
| HUMPHOSLIP_PEA_2_T17 (SEQ ID NO: 678) | 2291 | 2303 |
| HUMPHOSLIP_PEA_2_T18 (SEQ ID NO: 679) | 2505 | 2517 |
| HUMPHOSLIP_PEA_2_T19 (SEQ ID NO: 680) | 2659 | 2671 |

Segment cluster HUMPHOSLIP_PEA_2_node_72 (SEQ ID NO. 731) according to the present invention is supported by 7 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 76 below describes the starting and ending position of this segment on each transcript.

TABLE 76

Segment location on transcripts

| Transcript name | Segment starting position | Segment ending position |
|---|---|---|
| HUMPHOSLIP_PEA_2_T6 (SEQ ID NO: 674) | 2543 | 2647 |
| HUMPHOSLIP_PEA_2_T7 (SEQ ID NO: 675) | 2681 | 2785 |
| HUMPHOSLIP_PEA_2_T14 (SEQ ID NO: 676) | 2674 | 2778 |
| HUMPHOSLIP_PEA_2_T16 (SEQ ID NO: 677) | 2582 | 2686 |
| HUMPHOSLIP_PEA_2_T17 (SEQ ID NO: 678) | 2304 | 2408 |
| HUMPHOSLIP_PEA_2_T18 (SEQ ID NO: 679) | 2518 | 2622 |
| HUMPHOSLIP_PEA_2_T19 (SEQ ID NO: 680) | 2672 | 2776 |

Segment cluster HUMPHOSLIP_PEA_2_node_73 (SEQ ID NO: 732) according to the present invention is supported by 5 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 77 below describes the starting and ending position of this segment on each transcript.

TABLE 77

Segment location on transcripts

| Transcript name | Segment starting position | Segment ending position |
|---|---|---|
| HUMPHOSLIP_PEA_2_T6 (SEQ ID NO: 674) | 2648 | 2755 |
| HUMPHOSLIP_PEA_2_T7 (SEQ ID NO: 675) | 2786 | 2893 |
| HUMPHOSLIP_PEA_2_T14 (SEQ ID NO: 676) | 2779 | 2886 |
| HUMPHOSLIP_PEA_2_T16 (SEQ ID NO: 677) | 2687 | 2794 |
| HUMPHOSLIP_PEA_2_T17 (SEQ ID NO: 678) | 2409 | 2516 |
| HUMPHOSLIP_PEA_2_T18 (SEQ ID NO: 679) | 2623 | 2730 |
| HUMPHOSLIP_PEA_2_T19 (SEQ ID NO: 680) | 2777 | 2884 |

Segment cluster HUMPHOSLIP_PEA_2_node_74 (SEQ ID NO: 733) according to the present invention is supported by 10 libraries. The number of libraries was determined as previously described. This segment can be found in the following transcript(s): HUMPHOSLIP_PEA_2_T6 (SEQ ID NO: 674), HUMPHOSLIP_PEA_2_T7 (SEQ ID NO: 675), HUMPHOSLIP_PEA_2_T14 (SEQ ID NO: 676), HUMPHOSLIP_PEA_2_T16 (SEQ ID NO: 677), HUMPHOSLIP_PEA_2_T17 (SEQ ID NO: 678), HUMPHOSLIP_PEA_2_T18 (SEQ ID NO: 679) and HUMPHOSLIP_PEA_2_T19 (SEQ ID NO: 680). Table 78 below describes the starting and ending position of this segment on each transcript.

TABLE 78

Segment location on transcripts

| Transcript name | Segment starting position | Segment ending position |
|---|---|---|
| HUMPHOSLIP_PEA_2_T6 (SEQ ID NO: 674) | 2756 | 2845 |
| HUMPHOSLIP_PEA_2_T7 (SEQ ID NO: 675) | 2894 | 2983 |
| HUMPHOSLIP_PEA_2_T14 (SEQ ID NO: 676) | 2887 | 2976 |
| HUMPHOSLIP_PEA_2_T16 (SEQ ID NO: 677) | 2795 | 2884 |
| HUMPHOSLIP_PEA_2_T17 (SEQ ID NO: 678) | 2517 | 2606 |
| HUMPHOSLIP_PEA_2_T18 (SEQ ID NO: 679) | 2731 | 2820 |
| HUMPHOSLIP_PEA_2_T19 (SEQ ID NO: 680) | 2885 | 2974 |

Variant protein alignment to the previously known protein:

Sequence name: PLTP_HUMAN

Sequence documentation:

Alignment of: HUMPHOSLIP_PEA_2_P10 (SEQ ID NO: 735) x PLTP_HUMAN . . .

Alignment segment 1/1:

Quality: 3716.00

Escore: 0

Matching length: 398 Total length: 493

Matching Percent Similarity: 100.00 Matching Percent

Identity: 100.00

Total Percent Similarity: 80.73 Total Percent

Identity: 80.73

Gaps: 1

Alignment:

```
  1 MALFGALFLALLAGAHAEFPGCKIRVTSKALELVKQEGLRFLEQELETIT  50
    |||||||||||||||||||||||||||||||||||||||||||||||||
  1 MALFGALFLALLAGAHAEFPGCKIRVTSKALELVKQEGLRFLEQELETIT  50

51 IPDLRGKEGHFYYNISE................................  67
    |||||||||||||||||
 51 IPDLRGKEGHFYYNISEVKVTELQLTSSELDFQPQQELMLQITNASLGLR 100
```

-continued

```
 67 ..............................................  67

101 FRRQLLYWFFYDGGYINASAEGVSIRTGLELSRDPAGRMKVSNVSCQASV 150

68 ............KVYDFLSTFITSGMRFLLNQQICPVLYHAGTVLLNSLL 105
                ||||||||||||||||||||||||||||||||||||||
151 SRMHAAFGGTFKKVYDFLSTFITSGMRFLLNQQICPVLYHAGTVLLNSLL 200

106 DTVPVRSSVDELVGIDYSLMKDPVASTSNLDMDFRGAFFPLTERNWSLPN 155
    |||||||||||||||||||||||||||||||||||||||||||||||||
201 DTVPVRSSVDELVGIDYSLMKDPVASTSNLDMDFRGAFFPLTERNWSLPN 250

156 RAVEPQLQEEERMVYVAFSEFFFDSAMESYFRAGALQLLLVGDKVPHDLD 205
    |||||||||||||||||||||||||||||||||||||||||||||||||
251 RAVEPQLQEEERMVYVAFSEFFFDSAMESYFRAGALQLLLVGDKVPHDLD 300

206 MLLRATYFGSIVLLSPAVIDSPLKLELRVLAPPRCTIKPSGTTISVTASV 255
    ||||||||| ||||||||||||||||||||||||||||| ||||||||
301 MLLRATYFHSIVLLSPAVIDSPLKLELRVLAPPRCTIKPSFTTISVTASV 350

256 TIALVPPDQPEVQLSSMTMDARLSAKMALRGKALRTQLDLRRFRIYSNHS 305
    |||||||||||||||||||||||||||||||||||||||||||||||||
351 TIALVPPDQPEVQLSSMTMDARLSAKMALRGKALRTQLDLRRFRIYSNHS 400

306 ALESLALIPLQAPLKTMLQIGVMPMLNERTWRGVQIPLPEGINFVHEVVT 355
    ||||||||||||||||||| |||||||| |||||||| |||||||||||
401 ALESLALIPLQAPLKTMLQIFVMPMLNERTRGVQIPLPEEGINFVHEVVT 450

356 NHAGFLTIGADLHFAKGLREVIEKNRPADVRASTAPTPSTAAV        398
    ||||||||||||| ||||||||||||||||||||||||||||
451 NHAGFLTIGADLHRAKGLREVIEKNRPADVRASTAPTPSTAAV        493
```

Sequence name: PLTP_HUMAN

Sequence documentation:

Alignment of: HUMPHOSLIP_PEA_2_P12 (SEQ ID NO: 736) x PLTP_HUMAN . . .

Alignment segment 1/1:
  Quality: 4101.00

Escore: 0
  Matching length: 427 Total length: 427

Matching Percent Similarity: 100.00 Matching Percent Identity: 100.00

Total Percent Similarity: 100.00 Total Percent Identity: 100.00

Gaps: 0

Alignment:

```
  1 MALFGALFLALLAGAHAEFPGCKIRVTSKALELVKQEGLRFLEQELETIT  50
    |||||||||||||||||||||||||||||||||||| ||||||||||||
  1 MALFGALFLALLAGAHAEFPGCKIRVTSKALELVKQEHLRFLEQELETIT  50

51 IPDLRGKEGHFYYNISEVKVTELQLTSSELDFQPQQELMLQITNASLGLR 100
    |||||||||||||||||||||||||||||||||||||||||||||||||
 51 IPDLRGKEGHFYYNISEVKVTELQLTSSELDFQPQQELMLQITNASLGLR 100

101 FRRQLLYWFFYDGGYINASAEGVSIRTGLELSRDPAGRMKVSNVSCQASV 150
    |||||||||||||||||||||||||||||||||||||||||||||||||
101 FRRQLLYWFFYDGGYINASAEGVSIRTGLELSRDPAGRMKVSNVSCQASV 150

151 SRMHAAFGGTFKKVYDFLSTFITSGMRFLLNQQICPVLYHAGTVLLNSLL 200
    ||||||||||||||||||||||| |||||||||||||||||||||||||
151 SRMHAAFGGTFKKVYDFLSTFITSFMRFLLNQQICPVLYHAGTVLLNSLL 200

201 DTVPVRSSVDELVGIDYSLMKDPVASTSNLDMDFRGAFFPLTERNWSLPN 250
    |||||||||||| ||||||||||||||||||||||||||||||||||||
201 DTVPVRSSVDELBGIDYSLMKDPVASTSNLDMDFRGAFFPLTERNWSLPN 250

251 RAVEPQLQEEERMVYVAFSEFFFDSAMESYFRAGALQLLLVGDKVPHDLD 300
    |||||||||||||||||||||||||||||||||||||||||||||||||
251 RAVEPQLQEEERMVYVAFSEFFFDSAMESYFRAGALQLLLVGDKVPHDLD 300

301 MLLRATYFGSIVLLSPAVIDSPLKLELRVLAPPRCTIKPSGTTISVTASV 350
    |||||||||||||||||||||||||||||||||||||||||||||||||
301 MLLRATYFGSIVLLSPAVIDSPLKLELRVLAPPRCTIKPSGTTISVTASV 350
```

-continued

```
351 TIALVPPDQPEVQLSSMTMDARLSAKMALRGKALRTQLDLRRFRIYSNHS 400
    ||||||||||||||||||||||||||||||||||||||||||||||||||
351 TIALVPPDQPEVQLSSMTMDARLSAKMALRGKALRTQLDLRRFRIYSNHS 400

401 ALESLALIPLQAPLKTMLQIGVMPMLN                         427
    |||||||||||||||||||||||||||
401 ALESLALIPLQAPLKTMLQIGVMPMLN                         427
```

Sequence name: PLTP_HUMAN

Sequence documentation:

Alignment of: HUMPHOSLIP_PEA_2_P31 (SEQ ID NO: 738) x PLTP_HUMAN . . .

Alignment segment 1/1:
  Quality: 639.00

Escore: 0
  Matching length: 67 Total length: 67

Matching Percent Similarity: 100.00 Matching Percent

Identity: 100.00
  Total Percent Similarity: 100.00 Total Percent

Identity: 100.00
  Gaps: 0

Alignment:

```
 1 MALFGALFLALLAGAHAEFPGCKIRVTSKALELVKQEGLRFLEQELETIT 50
   |||||||||||||||||||||||||||||||||||||||||||||||||
 1 MALFGALFLALLAGAHAEFPGCKIRVTSKALELVKQEGLRFLEQELETIT 50

51 IPDLRGKEGHFYYNISE                                  67
   |||||||||||||||||
51 IPDLRGKEGHFYYNISE                                  67
```

Sequence name: PLTP_HUMAN

Sequence documentation:

Alignment of: HUMPHOSLIP_PEA_2_P33 (SEQ ID NO: 739) x PLTP_HUMAN . . .

Alignment segment 1/1:
  Quality: 1767.00

Escore: 0
  Matching length: 184 Total length: 184

Matching Percent Similarity: 100.00 Matching Percent

Identity: 99.46
  Total Percent Similarity: 100.00 Total Percent

Identity: 99.46
  Gaps: 0

Alignment:

```
  1 MALFGALFLALLAGAHAEFPGCKIRVTSKALELVKQEGLRFLEQELETIT  50
    |||||||||||||||||||||||||||||||||||||||||||||||||
  1 MALFGALFLALLAGAHAEFPGCKIRVTSKALELVKQEGLRFLEQELETIT  50

51 IPDLRGKEGHFYYNISEVKVTELQLTSSELDFQPQQELMLQITNASLGLR 100
    |||||||||||||||||||||||||||||||||||||||||||||||||
 51 IPDLRGKEGHFYYNISEVKVTELQLTSSELDFQPQQELMLQITNASLGLR 100

101 FRRQLLYWFFYDGGYINASAEGVSIRTGLELSRDPAGRMKVSNVSCQASV 150
    |||||||||||||||||||||||||||||||||||||||||||||||||
101 FRRQLLYWFFYDGGYINASAEGVSIRTGLELSRDPAGRMKVSNVSCQASV 150

151 SRMHAAFGGTFKKVYDFLSTFITSGMRFLLNQQV                 184
    |||||||||||||||||||||||||||||||||:
151 SRMHAAFGGTFKKVYDFLSTFITSGMRFLLNQQI                 184
```

Sequence name: PLTP_HUMAN

Sequence documentation:

Alignment of: HUMPHOSLIP_PEA_2_P34 (SEQ ID NO: 740) x PLTP_HUMAN . . .

Alignment segment 1/1:
  Quality: 1971.00

Escore: 0
  Matching length: 205 Total length: 205

Matching Percent Similarity: 100.00 Matching Percent

Identity: 100.00
  Total Percent Similarity: 100.00 Total Percent

Identity: 100.00
  Gaps: 0

Alignment:

length: 184

Matching Percent Similarity: 100.00 Matching Percent

Identity: 98.48
  Total Percent Similarity: 71.74 Total Percent

Identity: 70.65

Gaps: 1

```
  1 MALFGALFLALLAGAHAEFPGCKIRVTSKALELVKQEGLRFLEQELETIT  50
    |||||||||||||||||||||||||||||||||||||||||||||||||
  1 MALFGALFLALLAGAHAEFPGCKIRVTSKALELVKQEFLRFLEQELETIT  50

51 IPDLRGKEGHFYYNISEVKVTELQLTSSELDFQPQQELMLQITNASLGLR 100
    |||||||||||||||||||||||||||||||||||||||||||||||||
 51 IPDLRGKEGHFYYNISEVKVTELQLTSSELDFQPQQELMLQITNASLGLR 100

101 FRRQLLYWFFYDGGYINASAEGVSIRTGLELSRDPAGRMKVSNVSCQASV 150
    |||||||||||||||||||||||||||||||||||||||||||||||||
101 FRRQLLYWFFYDGGYINASAEGVSIRTGLELSRDPAGRMKVSNVSCQASV 150

151 SRMHAAFGGTFKKVYDFLSTFITSGMRFLLNQQICPVLYHAGTVLLNSLL 200
    |||||||||||||||||||||||||||||||||||||||||||||||||
151 SRMHAAFGGTFKKVYDFLSTFITSGMRFLLNQQICPVLYHAGTVLLNSLL 200
201 DTVPV                                             205
    |||||
201 DTVPV                                             205
```

Sequence name: PLTP_HUMAN

Alignment:

```
  1 MALFGALFLALLAGAHAEFPGCKIRVTSKALELVKQEGLRFLEQELETIT  50
    |||||||||||||||||||||||||||||||||||||||||||||||||
  1 MALFGALFLALLAGAHAEFPGCKIRVTSKALELVKQEGLRFLEQELETIT  50

51 IPDLRGKEGHFYYNISEVKVTELQLTSSELDFQPQQELMLQITNASLGLR 100
    |||||||||||||||||||||||||||||||||||||||||||||||||
 51 IPDLRGKEGHFYYNISEVKVTELQLTSSELDFQPQQELMLQITNASLGLR 100

101 FRRQLLYWFL........................................ 110
    ||||||||||:
101 FRRQLLYWFFYDGGYINASAEGVSIRTGLELSRDPAGRMKVSNVSCQASV 150

111 ............KVYDFLSTFITSGMRFLLNQQV                 132
                ||||||||||||||||||||:
151 SRMHAAFGGTFKKVYDFLSTFITSGMRFLLNQQI                 184
```

Sequence documentation:
Alignment of: HUMPHOSLIP_PEA_2_P35 (SEQ ID NO: 741) x PLTP_HUMAN . . .

Alignment segment 1/1:
  Quality: 1158.00

Escore: 0
  Matching length: 132 Total

DESCRIPTION FOR CLUSTER T59832

Cluster T59832 features 5 transcript(s) and 30 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| T59832_T6 | 742 |
| T59832_T8 | 743 |
| T59832_T11 | 744 |
| T59832_T15 | 745 |
| T59832_T22 | 746 |

TABLE 2

Segments of interest

| Segment Name | SEQ ID NO: |
|---|---|
| T59832_node_1 | 747 |
| T59832_node_7 | 748 |
| T59832_node_29 | 749 |
| T59832_node_39 | 750 |
| T59832_node_2 | 751 |
| T59832_node_3 | 752 |
| T59832_node_4 | 753 |
| T59832_node_5 | 754 |
| T59832_node_6 | 755 |
| T59832_node_8 | 756 |
| T59832_node_9 | 757 |
| T59832_node_10 | 758 |
| T59832_node_11 | 759 |
| T59832_node_12 | 760 |
| T59832_node_14 | 761 |
| T59832_node_16 | 762 |
| T59832_node_19 | 763 |
| T59832_node_20 | 764 |
| T59832_node_25 | 765 |
| T59832_node_26 | 766 |
| T59832_node_27 | 767 |
| T59832_node_28 | 768 |
| T59832_node_30 | 769 |
| T59832_node_31 | 770 |
| T59832_node_32 | 771 |
| T59832_node_34 | 772 |
| T59832_node_35 | 773 |
| T59832_node_36 | 774 |
| T59832_node_37 | 775 |
| T59832_node_38 | 776 |

TABLE 3

Proteins of interest

| Protein Name | SEQ ID NO: | Corresponding Transcript(s) |
|---|---|---|
| T59832_P5 | 778 | T59832_T6 (SEQ ID NO: 742) |
| T59832_P7 | 779 | T59832_T8 (SEQ ID NO: 743) |
| T59832_P9 | 780 | T59832_T11 (SEQ ID NO: 744) |
| T59832_P12 | 781 | T59832_T15 (SEQ ID NO: 745) |
| T59832_P18 | 782 | T59832_T22 (SEQ ID NO. 746) |

These sequences are variants of the known protein Gamma-interferon inducible lysosomal thiol reductase precursor (SwissProt accession identifier GILT_HUMAN; known also according to the synonyms Gamma-interferon-inducible protein IP-30), SEQ ID NO: 777, referred to herein as the previously known protein.

Protein Gamma-interferon inducible lysosomal thiol reductase precursor is known or believed to have the following function(s): cleaves disulfide bonds in proteins by reduction. May facilitate the complete unfolding of proteins destined for lysosomal degradation. May be involved in MHC class II-restricted antigen processing. The sequence for protein Gamma-interferon inducible lysosomal thiol reductase precursor is given at the end of the application, as "Gamma-interferon inducible lysosomal thiol reductase precursor amino acid sequence". Known polymorphisms for this sequence are as shown in Table 4.

TABLE 4

Amino acid mutations for Known Protein

| SNP position(s) on amino acid sequence | Comment |
|---|---|
| 109 | L - >S |
| 130 | H - >L |
| 157-261 | IVCMEEFEDMERSLPLCLQLYAPGLSPDTIMECAMG DRGMQ LMHANAQRTDALQPPHEYVPWVTVNGKPLEDQTQL LTLVCQ LYQGKKPDVCPSSTSSLRSVCFK - > MSGMAWKSLRTWRE VCHYACSSTPQGCRQNYHGVCNGGPRHAAHARQRP ADRCSP ATARVCALGHRQWETLGRSDPAPYPCLPVVPGQEA GCLPFL NQLPPECLLRVLAGGLRRAHGRRVGTRLPAFFSDPD PRHLL LTNWKILCIP |

Protein Gamma-interferon inducible lysosomal thiol reductase precursor localization is believed to be Lysosomal.

The following GO Annotation(s) apply to the previously known protein. The following annotation(s) were found: extracellular; lysosome, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster T59832 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 35 refer to weighted expression of ESTs in each category, as "parts per million" (ratio of the expression of ESTs for a particular cluster to the expression of all ESTs in that category, according to parts per million).

Figure 35:
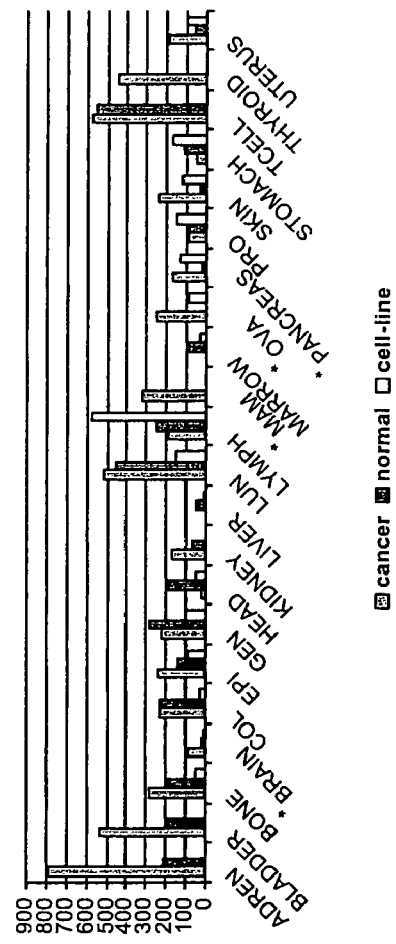
FIG. 35 shows cancer and cell-line vs. normal tissue expression.

Overall, the following results were obtained as shown with regard to the histograms in FIG. 35 and Table 5. This cluster is overexpressed (at least at a minimum level) in the following pathological conditions: brain malignant tumors, breast malignant tumors, ovarian carcinoma and pancreas carcinoma.

TABLE 5

Normal tissue distribution

| Name of Tissue | Number |
|---|---|
| adrenal | 208 |
| bladder | 205 |
| bone | 200 |
| brain | 18 |
| colon | 236 |

TABLE 5-continued

Normal tissue distribution

| Name of Tissue | Number |
|---|---|
| epithelial | 143 |
| general | 280 |
| head and neck | 192 |
| kidney | 71 |
| liver | 53 |
| lung | 459 |
| lymph nodes | 248 |
| breast | 0 |
| bone marrow | 94 |
| ovary | 0 |
| pancreas | 20 |
| prostate | 86 |
| skin | 29 |
| stomach | 109 |
| T cells | 557 |
| Thyroid | 0 |
| uterus | 63 |

TABLE 6

P values and ratios for expression in cancerous tissue

| Name of Tissue | P1 | P2 | SP1 | R3 | SP2 | R4 |
|---|---|---|---|---|---|---|
| adrenal | 4.9e−01 | 5.9e−01 | 4.7e−03 | 1.1 | 2.9e−02 | 0.8 |
| bladder | 3.7e−01 | 5.6e−01 | 3.7e−02 | 1.3 | 2.5e−01 | 0.9 |
| bone | 6.6e−01 | 6.7e−01 | 3.4e−01 | 0.6 | 9.1e−01 | 0.4 |
| brain | 1.8e−01 | 2.9e−01 | 4.3e−03 | 3.8 | 2.8e−02 | 2.5 |
| colon | 4.4e−01 | 5.2e−01 | 6.1e−01 | 0.9 | 8.1e−01 | 0.7 |
| epithelial | 2.5e−02 | 1.6e−01 | 1.2e−05 | 1.6 | 9.8e−02 | 1.1 |
| general | 1.3e−02 | 1.6e−01 | 1 | 0.8 | 1 | 0.6 |
| head and neck | 3.4e−01 | 3.3e−01 | 1 | 0.4 | 9.4e−01 | 0.5 |
| kidney | 7.7e−01 | 8.5e−01 | 1.4e−01 | 1.3 | 4.2e−01 | 0.9 |
| liver | 8.3e−01 | 7.6e−01 | 1 | 0.5 | 1 | 0.6 |
| lung | 5.7e−01 | 8.3e−01 | 3.5e−01 | 0.8 | 9.8e−01 | 0.5 |
| lymph nodes | 5.7e−01 | 6.6e−01 | 7.6e−01 | 0.8 | 3.6e−02 | 1.1 |
| breast | 5.0e−02 | 1.3e−01 | 2.5e−03 | 6.5 | 4.4e−02 | 3.6 |
| bone marrow | 6.2e−01 | 7.8e−01 | 1 | 0.3 | 9.5e−01 | 0.5 |
| ovary | 2.2e−01 | 9.4e−02 | 3.2e−03 | 6.1 | 8.3e−03 | 5.3 |
| pancreas | 9.0e−02 | 1.6e−01 | 1.1e−03 | 4.0 | 7.9e−04 | 4.2 |
| prostate | 8.1e−01 | 8.0e−01 | 5.7e−01 | 0.9 | 4.1e−01 | 0.9 |
| skin | 1.6e−01 | 1.2e−01 | 2.3e−02 | 6.0 | 1.0e−02 | 2.2 |
| stomach | 5.5e−01 | 7.4e−01 | 9.4e−01 | 0.6 | 4.9e−01 | 1.0 |
| T cells | 1 | 6.7e−01 | 6.9e−01 | 1.0 | 9.8e−01 | 0.5 |
| Thyroid | 2.3e−01 | 2.3e−01 | 5.9e−02 | 2.5 | 5.9e−02 | 2.5 |
| uterus | 7.4e−02 | 4.7e−02 | 2.2e−02 | 2.0 | 6.2e−02 | 1.7 |

As noted above, cluster T59832 features 5 transcript(s), which were listed in Table 1 above. These transcript(s) encode for protein(s) which are variant(s) of protein Gamma-interferon inducible lysosomal thiol reductase precursor. A description of each variant protein according to the present invention is now provided.

Variant protein T59832_P5 (SEQ ID NO: 778) according to the present invention has an amino acid sequence as given at the end of the application; it is encoded by transcript(s) T59832_T6 (SEQ ID NO: 742). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T59832_P5 (SEQ ID NO: 778) is encoded by the following transcript(s): T59832_T6 (SEQ ID NO: 742), for which the sequence(s) is/are given at the end of the application. The coding portion of transcript T59832_T6 (SEQ ID NO: 742) is shown in bold; this coding portion starts at position 149 and ends at position 715. The transcript also has the following SNPs as listed in Table 7 (given according to their position on the nucleotide sequence, with the alternative nucleic acid listed; the last column indicates whether the SNP is known or not; the presence of known SNPs in variant protein T59832_P5 (SEQ ID NO: 778) sequence provides support for the deduced sequence of this variant protein according to the present invention).

TABLE 7

Nucleic acid SNPs

| SNP position on nucleotide sequence | Alternative nucleic acid | Previously known SNP? |
|---|---|---|
| 61 | C − >T | Yes |
| 148 | G − >T | Yes |
| 212 | − >A | No |
| 241 | G − >T | No |
| 244 | A − >G | Yes |
| 962 | C − >T | Yes |
| 1074 | G − >A | Yes |
| 1248 | G − >C | Yes |
| 1441 | G − >A | Yes |
| 1443 | G − >A | No |
| 1505 | G − >C | Yes |
| 1651 | T − > | No |
| 1652 | T − >G | Yes |
| 1717 | C − >A | No |
| 1722 | C − > | No |
| 1722 | C − >G | No |
| 1752 | A − >G | Yes |
| 1817 | A − >G | Yes |
| 1854 | C − > | No |
| 1854 | C − >A | No |
| 1871 | C − >T | Yes |
| 1886 | T − >G | No |
| 1906 | G − >A | No |
| 1906 | G − >C | No |
| 1942 | C − > | No |
| 1942 | C − >T | No |
| 1971 | C − > | No |
| 1986 | G − >A | No |
| 2001 | G − >T | Yes |
| 2008 | A − > | No |
| 2030 | − >T | No |
| 2031 | C − >T | No |
| 2050 | C − > | No |
| 2056 | A − >G | Yes |
| 2068 | G − >A | Yes |
| 2111 | A − >C | Yes |
| 2136 | A − >C | Yes |
| 2144 | T − >C | Yes |

Variant protein T59832_P7 (SEQ ID NO: 779) according to the present invention has an amino acid sequence as given at the end of the application; it is encoded by transcript(s) T59832_T8 (SEQ ID NO: 743). An alignment is given to the known protein (Gamma-interferon inducible lysosomal thiol reductase precursor) at the end of the application. One or more alignments to one or more previously published protein sequences are given at the end of the application. A brief description of the relationship of the variant protein according to the present invention to each such aligned protein is as follows:

Comparison report between T59832_P7 (SEQ ID NO: 779) and GILT_HUMAN:

1. An isolated chimeric polypeptide encoding for T59832_P7 (SEQ ID NO: 779), comprising a first amino acid sequence being at least 90% homologous to MTLSPLLL-FLPPLLLLLDVPTAAVQASPLQALDFF- GNGPPVNYKTGNLYLRGPLKKSNA PLVNVTLY-
YEALCGGCRAFLIRELFPTWLLVMEILNVTLVPYGNA
QEQNVSGRWEFKC QHGEEECKFNKVEACVLDELD-
MELAFLTIVCMEEFEDMERSLPLCLQ-
LYAPGLSPDTIM ECAMGDRGMQLMHANAQRT-
DALQPPHEYVPWVTVNG corresponding to amino acids 12-223 of GILT_HUMAN, which also corresponds to amino acids 1-212 of T59832_P7 (SEQ ID NO: 779), and a second amino acid sequence being at least 70%, optionally at least 80%, preferably at least 85%, more preferably at least 90% and most preferably at least 95% homologous to a polypeptide having the sequence VRIFLALSLTLIVPWSQG-WTRQRDQR (SEQ ID NO: 1089) corresponding to amino acids 213-238 of T59832_P7 (SEQ ID NO: 779), wherein said first amino acid sequence and second amino acid sequence are contiguous and in a sequential order.

2. An isolated polypeptide encoding for a tail of T59832_P7 (SEQ ID NO: 779), comprising a polypeptide being at least 70%, optionally at least about 80%, preferably at least about 85%, more preferably at least about 90% and most preferably at least about 95% homologous to the sequence VRIFLALSLTLIVPWSQGWTRQRDQR (SEQ ID NO: 1089) in T59832_P7 (SEQ ID NO: 779).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide.

Variant protein T59832_P7 (SEQ ID NO: 779) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein T59832_P7 (SEQ ID NO: 779) sequence provides support for the deduced sequence of this variant protein according to the present invention).

TABLE 8

Amino acid mutations

| SNP position(s) on amino acid sequence | Alternative amino acid(s) | Previously known SNP? |
|---|---|---|
| 76 | R - >Q | Yes |
| 77 | A - >T | No |
| 146 | I - > | No |
| 146 | I - >M | Yes |
| 168 | P - >Q | No |
| 170 | L - > | No |
| 170 | L - >V | No |
| 180 | M - >V | Yes |

The glycosylation sites of variant protein T59832_P7 (SEQ ID NO: 779), as compared to the known protein Gamma-interferon inducible lysosomal thiol reductase precursor, are described in Table 9 (given according to their position(s) on the amino acid sequence in the first column; the second column indicates whether the glycosylation site is present in the variant protein; and the last column indicates whether the position is different on the variant protein).

TABLE 9

Glycosylation site(s)

| Position(s) on known amino acid sequence | Present in variant protein? | Position in variant protein? |
|---|---|---|
| 119 | yes | 108 |
| 106 | yes | 95 |
| 74 | yes | 63 |

Variant protein T59832_P7 (SEQ ID NO: 779) is encoded by the following transcript(s): T59832_T8 (SEQ ID NO: 743), for which the sequence(s) is/are given at the end of the application. The coding portion of transcript T59832_T8 (SEQ ID NO: 743) is shown in bold; this coding portion starts at position 149 and ends at position 862. The transcript also has the following SNPs as listed in Table 10 (given according to their position on the nucleotide sequence, with the alternative nucleic acid listed; the last column indicates whether the SNP is known or not; the presence of known SNPs in variant protein T59832_P7 (SEQ ID NO: 779) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 61 | C -> T | Yes |
| 148 | G -> T | Yes |
| 212 | -> A | No |
| 241 | G -> T | No |
| 244 | A -> G | Yes |
| 375 | G -> A | Yes |
| 377 | G -> A | No |
| 439 | G -> C | Yes |
| 585 | T -> | No |
| 586 | T -> G | Yes |
| 651 | C -> A | No |
| 656 | C -> | No |
| 656 | C -> G | No |
| 686 | A -> G | Yes |
| 751 | A -> G | Yes |
| 1004 | T -> G | Yes |
| 1206 | C -> | No |
| 1206 | C -> A | No |
| 1223 | C -> T | Yes |
| 1238 | T -> G | No |
| 1258 | G -> A | No |
| 1258 | G -> C | No |
| 1294 | C -> | No |
| 1294 | C -> T | No |
| 1323 | C -> | No |
| 1338 | G -> A | No |
| 1353 | G -> T | Yes |
| 1360 | A -> | No |
| 1382 | -> T | No |
| 1383 | C -> T | No |
| 1402 | C -> | No |
| 1408 | A -> G | Yes |
| 1420 | G -> A | Yes |
| 1463 | A -> C | Yes |
| 1488 | A -> C | Yes |
| 1496 | T -> C | Yes |

Variant protein T59832_P9 (SEQ ID NO: 780) according to the present invention has an amino acid sequence as given at the end of the application; it is encoded by transcript(s) T59832_T11 (SEQ ID NO: 744). An alignment is given to the known protein (Gamma-interferon inducible lysosomal thiol reductase precursor) at the end of the application. One or more alignments to one or more previously published protein sequences are given at the end of the application. A brief description of the relationship of the variant protein according to the present invention to each such aligned protein is as follows:

Comparison report between T59832_P9 (SEQ ID NO: 780) and GILT_HUMAN:

1. An isolated chimeric polypeptide encoding for T59832_P9 (SEQ ID NO: 780), comprising a first amino acid sequence being at least 90% homologous to MTLSPLLL-FLPPLLLLLDVPTAAVQASPLQALDFF-GNGPPVNYKTGNLYLRGPLKKSNA PLVNVTLY-YEALCGGCRAFLIRELFPTWLLVMEILNVTLVPYGNA QEQNVSGRWEFKC QHGEEECKFNKVEACVLDELD-MELAFLTIVCMEEFEDMERSLPLCLQ-LYAPGLSPDTIM ECAMGDRGMQLMHANAQRT-DALQPPHE corresponding to amino acids 12-214 of GILT_HUMAN, which also corresponds to amino acids 1-203 of T59832_P9 (SEQ ID NO: 780), and a second amino acid sequence being at least 70%, optionally at least 80%, preferably at least 85%, more preferably at least 90% and most preferably at least 95% homologous to a polypeptide having the sequence NPWKIRPSSLPLSASCTRARSRM-SALPQPAPSGVFASSDGR (SEQ ID NO: 1090) corresponding to amino acids 204-244 of T59832_P9 (SEQ ID NO: 780), wherein said first amino acid sequence and second amino acid sequence are contiguous and in a sequential order.

2. An isolated polypeptide encoding for a tail of T59832_P9 (SEQ ID NO: 780), comprising a polypeptide being at least 70%, optionally at least about 80%, preferably at least about 85%, more preferably at least about 90% and most preferably at least about 95% homologous to the sequence NPWKIRPSSLPLSASCTRARSRMSALPQ-PAPSGVFASSDGR (SEQ ID NO: 1090) in T59832_P9 (SEQ ID NO: 780).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T59832_P9 (SEQ ID NO: 780) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein T59832_P9 (SEQ ID NO: 780) sequence provides support for the deduced sequence of this variant protein according to the present invention).

TABLE 11

Amino acid mutations

| SNP position(s) on amino acid sequence | Alternative amino acid(s) | Previously known SNP? |
|---|---|---|
| 76 | R -> Q | Yes |
| 77 | A -> T | No |
| 146 | I -> | No |
| 146 | I -> M | Yes |
| 168 | P -> Q | No |
| 170 | L -> | No |

TABLE 11-continued

Amino acid mutations

| SNP position(s) on amino acid sequence | Alternative amino acid(s) | Previously known SNP? |
|---|---|---|
| 170 | L -> V | No |
| 180 | M -> V | Yes |
| 204 | N -> | No |
| 204 | N -> K | No |
| 210 | P -> L | Yes |
| 215 | L -> W | No |
| 222 | A -> T | No |
| 222 | A -> P | No |
| 234 | P -> | No |
| 234 | P -> S | No |
| 243 | G -> | No |

The glycosylation sites of variant protein T59832_P9 (SEQ ID NO: 780), as compared to the known protein Gamma-interferon inducible lysosomal thiol reductase precursor, are described in Table 12 (given according to their position(s) on the amino acid sequence in the first column; the second column indicates whether the glycosylation site is present in the variant protein; and the last column indicates whether the position is different on the variant protein).

TABLE 12

Glycosylation site(s)

| Position(s) on known amino acid sequence | Present in variant protein? | Position in variant protein? |
|---|---|---|
| 119 | yes | 108 |
| 106 | yes | 95 |
| 74 | yes | 63 |

Variant protein T59832_P9 (SEQ ID NO: 780) is encoded by the following transcript(s): T59832_T11 (SEQ ID NO: 744), for which the sequence(s) is/are given at the end of the application. The coding portion of transcript T59832_T11 (SEQ ID NO: 744) is shown in bold; this coding portion starts at position 149 and ends at position 880. The transcript also has the following SNPs as listed in Table 13 (given according to their position on the nucleotide sequence, with the alternative nucleic acid listed; the last column indicates whether the SNP is known or not; the presence of known SNPs in variant protein T59832_P9 (SEQ ID NO: 780) sequence provides support for the deduced sequence of this variant protein according to the present invention).

TABLE 13

Nucleic acid SNPs

| SNP position on nucleotide sequence | Alternative nucleic acid | Previously known SNP? |
|---|---|---|
| 61 | C -> T | Yes |
| 148 | G -> T | Yes |
| 212 | -> A | No |
| 241 | G -> T | No |
| 244 | A -> G | Yes |
| 375 | G -> A | Yes |
| 377 | G -> A | No |
| 439 | G -> C | Yes |
| 585 | T -> | No |
| 586 | T -> G | Yes |
| 651 | C -> A | No |
| 656 | C -> | No |
| 656 | C -> G | No |

TABLE 13-continued

Nucleic acid SNPs

| SNP position on nucleotide sequence | Alternative nucleic acid | Previously known SNP? |
|---|---|---|
| 686 | A -> G | Yes |
| 751 | A -> G | Yes |
| 760 | C -> | No |
| 760 | C -> A | No |
| 777 | C -> T | Yes |
| 792 | T -> G | No |
| 812 | G -> A | No |
| 812 | G -> C | No |
| 848 | C -> | No |
| 848 | C -> T | No |
| 877 | C -> | No |
| 892 | G -> A | No |
| 907 | G -> T | Yes |
| 914 | A -> | No |
| 936 | -> T | No |
| 937 | C -> T | No |
| 956 | C -> | No |
| 962 | A -> G | Yes |
| 974 | G -> A | Yes |
| 1017 | A -> C | Yes |
| 1042 | A -> C | Yes |
| 1050 | T -> C | Yes |

Variant protein T59832_P12 (SEQ ID NO: 781) according to the present invention has an amino acid sequence as given at the end of the application; it is encoded by transcript(s) T59832_T15 (SEQ ID NO: 745). An alignment is given to the known protein (Gamma-interferon inducible lysosomal thiol reductase precursor) at the end of the application. One or more alignments to one or more previously published protein sequences are given at the end of the application. A brief description of the relationship of the variant protein according to the present invention to each such aligned protein is as follows:

Comparison report between T59832_P12 (SEQ ID NO: 781) and GILT_HUMAN:

1. An isolated chimeric polypeptide encoding for T59832_P12 (SEQ ID NO: 781), comprising a first amino acid sequence being at least 90% homologous to MTLSPLLLFLPPLLLLLDVPTAAVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVE corresponding to amino acids 12-141 of GILT_HUMAN, which also corresponds to amino acids 1-130 of T59832_P12 (SEQ ID NO: 781), and a second amino acid sequence being at least 90% homologous to CLQ-LYAPGLSPDTIMECAMGDRGMQLMHA-NAQRTDALQPPHEYVPWVTVNGKPLED QTQLLTLVCQLYQGKKPDVCPSSTSSLRSVCFK corresponding to amino acids 173-261 of GILT_HUMAN, which also corresponds to amino acids 131-219 of T59832_P12 (SEQ ID NO: 781), wherein said first amino acid sequence and second amino acid sequence are contiguous and in a sequential order.

2. An isolated chimeric polypeptide encoding for an edge portion of T59832_P12 (SEQ ID NO: 781), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EC, having a structure as follows: a sequence starting from any of amino acid numbers 130–x to 130; and ending at any of amino acid numbers 131+((n–2)–x), in which x varies from 0 to n–2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T59832_P12 (SEQ ID NO: 781) also has the following non-silent SNPs (Single Nucleotide Polymorphisms) as listed in Table 14, (given according to their position(s) on the amino acid sequence, with the alternative amino acid(s) listed; the last column indicates whether the SNP is known or not; the presence of known SNPs in variant protein T59832_P12 (SEQ ID NO: 781) sequence provides support for the deduced sequence of this variant protein according to the present invention).

TABLE 14

Amino acid mutations

| SNP position(s) on amino acid sequence | Alternative amino acid(s) | Previously known SNP? |
|---|---|---|
| 76 | R -> Q | Yes |
| 77 | A -> T | No |
| 137 | P -> Q | No |
| 139 | L -> | No |
| 139 | L -> V | No |
| 149 | M -> V | Yes |
| 183 | P -> | No |
| 183 | P -> T | No |
| 200 | G -> A | No |
| 200 | G -> D | No |
| 212 | S -> | No |
| 212 | S -> F | No |

The glycosylation sites of variant protein T59832_P12 (SEQ ID NO: 781), as compared to the known protein Gamma-interferon inducible lysosomal thiol reductase precursor, are described in Table 15 (given according to their position(s) on the amino acid sequence in the first column; the second column indicates whether the glycosylation site is present in the variant protein; and the last column indicates whether the position is different on the variant protein).

TABLE 15

Glycosylation site(s)

| Position(s) on known amino acid sequence | Present in variant protein? | Position in variant protein? |
|---|---|---|
| 119 | yes | 108 |
| 106 | yes | 95 |
| 74 | yes | 63 |

Variant protein T59832_P12 (SEQ ID NO: 781) is encoded by the following transcript(s): T59832_T15 (SEQ ID NO: 745), for which the sequence(s) is/are given at the end of the application. The coding portion of transcript T59832_T15 (SEQ ID NO: 745) is shown in bold; this coding portion starts at position 149 and ends at position 805. The transcript also has the following SNPs as listed in Table 16 (given according to their position on the nucleotide sequence, with the alternative nucleic acid listed; the last column indicates whether the SNP is known or not; the presence of known SNPs in variant protein T59832_P12 (SEQ ID NO: 781) sequence provides support for the deduced sequence of this variant protein according to the present invention).

TABLE 16

Nucleic acid SNPs

| SNP position on nucleotide sequence | Alternative nucleic acid | Previously known SNP? |
|---|---|---|
| 61 | C -> T | Yes |
| 148 | G -> T | Yes |
| 212 | -> A | No |
| 241 | G -> T | No |
| 244 | A -> G | Yes |
| 375 | G -> A | Yes |
| 377 | G -> A | No |
| 439 | G -> C | Yes |
| 558 | C -> A | No |
| 563 | C -> | No |
| 563 | C -> G | No |
| 593 | A -> G | Yes |
| 658 | A -> G | Yes |
| 695 | C -> | No |
| 695 | C -> A | No |
| 712 | C -> T | Yes |
| 727 | T -> G | No |
| 747 | G -> A | No |
| 747 | G -> C | No |
| 783 | C -> | No |
| 783 | C -> T | No |
| 812 | C -> | No |
| 827 | G -> A | No |
| 842 | G -> T | Yes |
| 849 | A -> | No |
| 871 | -> T | No |
| 872 | C -> T | No |
| 891 | C -> | No |
| 897 | A -> G | Yes |
| 909 | G -> A | Yes |
| 952 | A -> C | Yes |
| 977 | A -> C | Yes |
| 985 | T -> C | Yes |

Variant protein T59832_P18 (SEQ ID NO: 782) according to the present invention has an amino acid sequence as given at the end of the application; it is encoded by transcript(s) T59832_T22 (SEQ ID NO. 746). An alignment is given to the known protein (Gamma-interferon inducible lysosomal thiol reductase precursor) at the end of the application. One or more alignments to one or more previously published protein sequences are given at the end of the application. A brief description of the relationship of the variant protein according to the present invention to each such aligned protein is as follows:

Comparison report between T59832_P18 (SEQ ID NO: 782) and GILT_HUMAN:

1. An isolated chimeric polypeptide encoding for T59832_P18 (SEQ ID NO: 782), comprising a first amino acid sequence being at least 90% homologous to MTLSPLLLFLPPLLLLLDVPTAAVQAS-PLQALDFFGNGPPVNYK corresponding to amino acids 12-55 of GILT_HUMAN, which also corresponds to amino acids 1-44 of T59832_P18 (SEQ ID NO: 782), and a second amino acid sequence being at least 90% homologous to CLQ-LYAPGLSPDTIMECAMGDRGMQLMHA-NAQRTDALQPPHEYVPWVTVNGKPLED QTQLLTLVCQLYQGKKPDVCPSSTSSLRSVCFK corresponding to amino acids 173-261 of GILT_HUMAN, which also corresponds to amino acids 45-133 of T59832_P18 (SEQ ID NO: 782), wherein said first amino acid sequence and second amino acid sequence are contiguous and in a sequential order.

2. An isolated chimeric polypeptide encoding for an edge portion of T59832_P18 (SEQ ID NO: 782), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KC, having a structure as follows: a sequence starting from any of amino acid numbers 44−x to 44; and ending at any of amino acid numbers 45+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T59832_P18 (SEQ ID NO: 782) also has the following non-silent SNPs (Single Nucleotide Polymorphisms) as listed in Table 17, (given according to their position(s) on the amino acid sequence, with the alternative amino acid(s) listed; the last column indicates whether the SNP is known or not; the presence of known SNPs in variant protein T59832_P18 (SEQ ID NO: 782) sequence provides support for the deduced sequence of this variant protein according to the present invention).

TABLE 17

Amino acid mutations

| SNP position(s) on amino acid sequence | Alternative amino acid(s) | Previously known SNP? |
|---|---|---|
| 51 | P -> Q | No |
| 53 | L -> V | No |
| 53 | L -> | No |
| 63 | M -> V | Yes |
| 97 | P -> | No |
| 97 | P -> T | No |
| 114 | G -> A | No |
| 114 | G -> D | No |
| 126 | S -> F | No |
| 126 | S -> | No |

The glycosylation sites of variant protein T59832_P18 (SEQ ID NO: 782), as compared to the known protein Gamma-interferon inducible lysosomal thiol reductase precursor, are described in Table 18 (given according to their position(s) on the amino acid sequence in the first column; the second column indicates whether the glycosylation site is present in the variant protein; and the last column indicates whether the position is different on the variant protein).

TABLE 18

Glycosylation site(s)

| Position(s) on known amino acid sequence | Present in variant protein? |
|---|---|
| 119 | no |
| 106 | no |
| 74 | no |

Variant protein T59832_P18 (SEQ ID NO: 782) is encoded by the following transcript(s): T59832_T22 (SEQ ID NO. 746), for which the sequence(s) is/are given at the end of the application. The coding portion of transcript T59832_T22 (SEQ ID NO. 746) is shown in bold; this coding portion starts at position 149 and ends at position 547. The transcript also has the following SNPs as listed in Table 19 (given according to their position on the nucleotide sequence, with the alternative nucleic acid listed; the last column indicates whether the SNP is known or not; the presence of known SNPs in variant protein T59832_P18 (SEQ ID NO: 782) sequence provides support for the deduced sequence of this variant protein according to the present invention).

TABLE 19

Nucleic acid SNPs

| SNP position on nucleotide sequence | Alternative nucleic acid | Previously known SNP? |
|---|---|---|
| 61 | C -> T | Yes |
| 148 | G -> T | Yes |
| 212 | -> A | No |
| 241 | G -> T | No |
| 244 | A -> G | Yes |
| 300 | C -> A | No |
| 305 | C -> | No |
| 305 | C -> G | No |
| 335 | A -> G | Yes |
| 400 | A -> G | Yes |
| 437 | C -> | No |
| 437 | C -> A | No |
| 454 | C -> T | Yes |
| 469 | T -> G | No |
| 489 | G -> A | No |
| 489 | G -> C | No |
| 525 | C -> | No |
| 525 | C -> T | No |
| 554 | C -> | No |
| 569 | G -> A | No |
| 584 | G -> T | Yes |
| 591 | A -> | No |
| 613 | -> T | No |
| 614 | C -> T | No |
| 633 | C -> | No |
| 639 | A -> G | Yes |
| 651 | G -> A | Yes |
| 694 | A -> C | Yes |
| 719 | A -> C | Yes |
| 727 | T -> C | Yes |

As noted above, cluster T59832 features 30 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T59832_node_1 (SEQ ID NO: 747) according to the present invention is supported by 62 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 20 below describes the starting and ending position of this segment on each transcript.

TABLE 20

Segment location on transcripts

| Transcript name | Segment starting position | Segment ending position |
|---|---|---|
| T59832_T6 (SEQ ID NO: 742) | 1 | 123 |
| T59832_T8 (SEQ ID NO: 743) | 1 | 123 |
| T59832_T11 (SEQ ID NO: 744) | 1 | 123 |
| T59832_T15 (SEQ ID NO: 745) | 1 | 123 |
| T59832_T22 (SEQ ID NO. 746) | 1 | 123 |

Segment cluster T59832_node_7 (SEQ ID NO: 748) according to the present invention is supported by 8 libraries. The number of libraries was determined as previously described. This segment can be found in the following transcript(s): T59832_T6 (SEQ ID NO: 742). Table 21 below describes the starting and ending position of this segment on each transcript.

TABLE 21

Segment location on transcripts

| Transcript name | Segment starting position | Segment ending position |
|---|---|---|
| T59832_T6 (SEQ ID NO: 742) | 281 | 1346 |

Segment cluster T59832_node_29 (SEQ ID NO: 749) according to the present invention is supported by 12 libraries. The number of libraries was determined as previously described. This segment can be found in the following transcript(s): T59832_T8 (SEQ ID NO: 743). Table 22 below describes the starting and ending position of this segment on each transcript.

TABLE 22

Segment location on transcripts

| Transcript name | Segment starting position | Segment ending position |
|---|---|---|
| T59832_T8 (SEQ ID NO: 743) | 785 | 1202 |

Segment cluster T59832_node_39 (SEQ ID NO: 750)) according to the present invention is supported by 195 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 23 below describes the starting and ending position of this segment on each transcript.

TABLE 23

Segment location on transcripts

| Transcript name | Segment starting position | Segment ending position |
|---|---|---|
| T59832_T6 (SEQ ID NO: 742) | 2125 | 2178 |
| T59832_T8 (SEQ ID NO: 743) | 1477 | 1530 |
| T59832_T11 (SEQ ID NO: 744) | 1031 | 1084 |
| T59832_T15 (SEQ ID NO: 745) | 966 | 1019 |
| T59832_T22 (SEQ ID NO. 746) | 708 | 761 |

According to an optional embodiment of the present invention, short segments related to the above cluster are also provided. These segments are up to about 120 bp in length, and so are included in a separate description.

Segment cluster T59832_node_2 (SEQ ID NO: 751) according to the present invention is supported by 258 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 24 below describes the starting and ending position of this segment on each transcript.

TABLE 24

Segment location on transcripts

| Transcript name | Segment starting position | Segment ending position |
|---|---|---|
| T59832_T6 (SEQ ID NO: 742) | 124 | 154 |
| T59832_T8 (SEQ ID NO: 743) | 124 | 154 |
| T59832_T11 (SEQ ID NO: 744) | 124 | 154 |
| T59832_T15 (SEQ ID NO: 745) | 124 | 154 |
| T59832_T22 (SEQ ID NO. 746) | 124 | 154 |

Segment cluster T59832_node_3 (SEQ ID NO: 752) according to the present invention can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 25 below describes the starting and ending position of this segment on each transcript.

TABLE 25

Segment location on transcripts

| Transcript name | Segment starting position | Segment ending position |
|---|---|---|
| T59832_T6 (SEQ ID NO: 742) | 155 | 172 |
| T59832_T8 (SEQ ID NO: 743) | 155 | 172 |
| T59832_T11 (SEQ ID NO: 744) | 155 | 172 |
| T59832_T15 (SEQ ID NO: 745) | 155 | 172 |
| T59832_T22 (SEQ ID NO. 746) | 155 | 172 |

Segment cluster T59832_node_4 (SEQ ID NO: 753) according to the present invention is supported by 296 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 26 below describes the starting and ending position of this segment on each transcript.

TABLE 26

Segment location on transcripts

| Transcript name | Segment starting position | Segment ending position |
|---|---|---|
| T59832_T6 (SEQ ID NO: 742) | 173 | 223 |
| T59832_T8 (SEQ ID NO: 743) | 173 | 223 |
| T59832_T11 (SEQ ID NO: 744) | 173 | 223 |
| T59832_T15 (SEQ ID NO: 745) | 173 | 223 |
| T59832_T22 (SEQ ID NO. 746) | 173 | 223 |

Segment cluster T59832_node_5 (SEQ ID NO: 754) according to the present invention is supported by 305 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 27 below describes the starting and ending position of this segment on each transcript.

TABLE 27

Segment location on transcripts

| Transcript name | Segment starting position | Segment ending position |
|---|---|---|
| T59832_T6 (SEQ ID NO: 742) | 224 | 259 |
| T59832_T8 (SEQ ID NO: 743) | 224 | 259 |
| T59832_T11 (SEQ ID NO: 744) | 224 | 259 |
| T59832_T15 (SEQ ID NO: 745) | 224 | 259 |
| T59832_T22 (SEQ ID NO. 746) | 224 | 259 |

Segment cluster T59832_node_6 (SEQ ID NO: 755) according to the present invention can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 28 below describes the starting and ending position of this segment on each transcript.

TABLE 28

Segment location on transcripts

| Transcript name | Segment starting position | Segment ending position |
|---|---|---|
| T59832_T6 (SEQ ID NO: 742) | 260 | 280 |
| T59832_T8 (SEQ ID NO: 743) | 260 | 280 |
| T59832_T11 (SEQ ID NO: 744) | 260 | 280 |
| T59832_T15 (SEQ ID NO: 745) | 260 | 280 |
| T59832_T22 (SEQ ID NO. 746) | 260 | 280 |

Segment cluster T59832_node_8 (SEQ ID NO: 756) according to the present invention can be found in the following transcript(s): T59832_T6 (SEQ ID NO: 742), T59832_T8 (SEQ ID NO: 743), T59832T11 (SEQ ID NO: 744) and T59832_T15 (SEQ ID NO: 745). Table 29 below describes the starting and ending position of this segment on each transcript.

TABLE 29

Segment location on transcripts

| Transcript name | Segment starting position | Segment ending position |
|---|---|---|
| T59832_T6 (SEQ ID NO: 742) | 1347 | 1367 |
| T59832_T8 (SEQ ID NO: 743) | 281 | 301 |
| T59832_T11 (SEQ ID NO: 744) | 281 | 301 |
| T59832_T15 (SEQ ID NO: 745) | 281 | 301 |

Segment cluster T59832_node_9 (SEQ ID NO: 757) according to the present invention is supported by 330 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744) and T59832_T15 (SEQ ID NO: 745). Table 30 below describes the starting and ending position of this segment on each transcript.

TABLE 30

Segment location on transcripts

| Transcript name | Segment starting position | Segment ending position |
|---|---|---|
| T59832_T6 (SEQ ID NO: 742) | 1368 | 1403 |
| T59832_T8 (SEQ ID NO: 743) | 302 | 337 |
| T59832_T11 (SEQ ID NO: 744) | 302 | 337 |
| T59832_T15 (SEQ ID NO: 745) | 302 | 337 |

Segment cluster T59832_node_10 (SEQ ID NO: 758) according to the present invention is supported by 332 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744) and T59832_T15 (SEQ ID NO: 745). Table 31 below describes the starting and ending position of this segment on each transcript.

TABLE 31

Segment location on transcripts

| Transcript name | Segment starting position | Segment ending position |
|---|---|---|
| T59832_T6 (SEQ ID NO: 742) | 1404 | 1448 |
| T59832_T8 (SEQ ID NO: 743) | 338 | 382 |
| T59832_T11 (SEQ ID NO: 744) | 338 | 382 |
| T59832_T15 (SEQ ID NO: 745) | 338 | 382 |

Segment cluster T59832_node_11 (SEQ ID NO: 759) according to the present invention is supported by 306 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744) and T59832_T15 (SEQ ID NO: 745). Table 32 below describes the starting and ending position of this segment on each transcript.

TABLE 32

Segment location on transcripts

| Transcript name | Segment starting position | Segment ending position |
|---|---|---|
| T59832_T6 (SEQ ID NO: 742) | 1449 | 1483 |
| T59832_T8 (SEQ ID NO: 743) | 383 | 417 |
| T59832_T11 (SEQ ID NO: 744) | 383 | 417 |
| T59832_T15 (SEQ ID NO: 745) | 383 | 417 |

Segment cluster T59832_node_12 (SEQ ID NO. 760) according to the present invention is supported by 280 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744) and T59832_T15 (SEQ ID NO: 745). Table 33 below describes the starting and ending position of this segment on each transcript.

TABLE 33

Segment location on transcripts

| Transcript name | Segment starting position | Segment ending position |
|---|---|---|
| T59832_T6 (SEQ ID NO: 742) | 1484 | 1529 |
| T59832_T8 (SEQ ID NO: 743) | 418 | 463 |
| T59832_T11 (SEQ ID NO: 744) | 418 | 463 |
| T59832_T15 (SEQ ID NO: 745) | 418 | 463 |

Segment cluster T59832_node__14 (SEQ ID NO: 761) according to the present invention is supported by 280 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744) and T59832_T15 (SEQ ID NO: 745). Table 34 below describes the starting and ending position of this segment on each transcript.

TABLE 34

Segment location on transcripts

| Transcript name | Segment starting position | Segment ending position |
|---|---|---|
| T59832_T6 (SEQ ID NO: 742) | 1530 | 1568 |
| T59832_T8 (SEQ ID NO: 743) | 464 | 502 |
| T59832_T11 (SEQ ID NO: 744) | 464 | 502 |
| T59832_T15 (SEQ ID NO: 745) | 464 | 502 |

Segment cluster T59832_node__16 (SEQ ID NO: 762) according to the present invention is supported by 287 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744) and T59832_T15 (SEQ ID NO: 745). Table 35 below describes the starting and ending position of this segment on each transcript.

TABLE 35

Segment location on transcripts

| Transcript name | Segment starting position | Segment ending position |
|---|---|---|
| T59832_T6 (SEQ ID NO: 742) | 1569 | 1604 |
| T59832_T8 (SEQ ID NO: 743) | 503 | 538 |
| T59832_T11 (SEQ ID NO: 744) | 503 | 538 |
| T59832_T15 (SEQ ID NO: 745) | 503 | 538 |

Segment cluster T59832_node__19 (SEQ ID NO: 763) according to the present invention is supported by 300 libraries. The number of libraries was determined as previously described. This segment can be found in the following transcript(s): T59832_T6 (SEQ ID NO: 742), T59832_T8 (SEQ ID NO: 743) and T59832_T11 (SEQ ID NO: 744). Table 36 below describes the starting and ending position of this segment on each transcript.

TABLE 36

Segment location on transcripts

| Transcript name | Segment starting position | Segment ending position |
|---|---|---|
| T59832_T6 (SEQ ID NO: 742) | 1605 | 1643 |
| T59832_T8 (SEQ ID NO: 743) | 539 | 577 |
| T59832_T11 (SEQ ID NO: 744) | 539 | 577 |

Segment cluster T59832_node__20 (SEQ ID NO: 764) according to the present invention is supported by 318 libraries. The number of libraries was determined as previously described. This segment can be found in the following transcript(s): T59832_T6 (SEQ ID NO: 742), T59832_T8 (SEQ ID NO: 743) and T59832_T11 (SEQ ID NO: 744). Table 37 below describes the starting and ending position of this segment on each transcript.

TABLE 37

Segment location on transcripts

| Transcript name | Segment starting position | Segment ending position |
|---|---|---|
| T59832_T6 (SEQ ID NO:742) | 1644 | 1697 |
| T59832_T8 (SEQ ID NO:743) | 578 | 631 |
| T59832_T11 (SEQ ID NO:744) | 578 | 631 |

Segment cluster T59832_node__25 (SEQ ID NO: 765) according to the present invention can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 38 below describes the starting and ending position of this segment on each transcript.

TABLE 38

Segment location on transcripts

| Transcript name | Segment starting position | Segment ending position |
|---|---|---|
| T59832_T6 (SEQ ID NO:742) | 1698 | 1719 |
| T59832_T8 (SEQ ID NO:743) | 632 | 653 |
| T59832_T11 (SEQ ID NO:744) | 632 | 653 |
| T59832_T15 (SEQ ID NO:745) | 539 | 560 |
| T59832_T22 (SEQ ID NO:746) | 281 | 302 |

Segment cluster T59832_node__26 (SEQ ID NO: 766) according to the present invention is supported by 342 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746).

Table 39 below describes the starting and ending position of this segment on each transcript.

TABLE 39

Segment location on transcripts

| Transcript name | Segment starting position | Segment ending position |
|---|---|---|
| T59832_T6 (SEQ ID NO:742) | 1720 | 1783 |
| T59832_T8 (SEQ ID NO:743) | 654 | 717 |
| T59832_T11 (SEQ ID NO:744) | 654 | 717 |
| T59832_T15 (SEQ ID NO:745) | 561 | 624 |
| T59832_T22 (SEQ ID NO:746) | 303 | 366 |

Segment cluster T59832_node_27 (SEQ ID NO: 767) according to the present invention is supported by 314 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 40 below describes the starting and ending position of this segment on each transcript.

TABLE 40

Segment location on transcripts

| Transcript name | Segment starting position | Segment ending position |
|---|---|---|
| T59832_T6 (SEQ ID NO:742) | 1784 | 1822 |
| T59832_T8 (SEQ ID NO:743) | 718 | 756 |
| T59832_T11 (SEQ ID NO:744) | 718 | 756 |
| T59832_T15 (SEQ ID NO:745) | 625 | 663 |
| T59832_T22 (SEQ ID NO:746) | 367 | 405 |

Segment cluster T59832_node_28 (SEQ ID NO: 768) according to the present invention is supported by 284 libraries. The number of libraries was determined as previously described. This segment can be found in the following transcript(s): T59832_T6 (SEQ ID NO: 742), T59832_T8 (SEQ ID NO: 743), T59832_T15 (SEQ ID NO: 745) and T59832_T22 (SEQ ID NO. 746). Table 41 below describes the starting and ending position of this segment on each transcript.

TABLE 41

Segment location on transcripts

| Transcript name | Segment starting position | Segment ending position |
|---|---|---|
| T59832_T6 (SEQ ID NO:742) | 1823 | 1850 |
| T59832_T8 (SEQ ID NO:743) | 757 | 784 |
| T59832_T15 (SEQ ID NO:745) | 664 | 691 |
| T59832_T22 (SEQ ID NO:746) | 406 | 433 |

Segment cluster T59832_node_30 (SEQ ID NO: 769) according to the present invention can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 42 below describes the starting and ending position of this segment on each transcript.

TABLE 42

Segment location on transcripts

| Transcript name | Segment starting position | Segment ending position |
|---|---|---|
| T59832_T6 (SEQ ID NO:742) | 1851 | 1854 |
| T59832_T8 (SEQ ID NO:743) | 1203 | 1206 |
| T59832_T11 (SEQ ID NO:744) | 757 | 760 |
| T59832_T15 (SEQ ID NO:745) | 692 | 695 |
| T59832_T22 (SEQ ID NO:746) | 434 | 437 |

Segment cluster T59832_node_31 (SEQ ID NO: 770) according to the present invention can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 43 below describes the starting and ending position of this segment on each transcript.

TABLE 43

Segment location on transcripts

| Transcript name | Segment starting position | Segment ending position |
|---|---|---|
| T59832_T6 (SEQ ID NO:742) | 1855 | 1874 |
| T59832_T8 (SEQ ID NO:743) | 1207 | 1226 |
| T59832_T11 (SEQ ID NO:744) | 761 | 780 |
| T59832_T15 (SEQ ID NO:745) | 696 | 715 |

Segment cluster T59832_node_32 (SEQ ID NO: 771) according to the present invention is supported by 287 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 44 below describes the starting and ending position of this segment on each transcript.

TABLE 43-continued

Segment location on transcripts

| Transcript name | Segment starting position | Segment ending position |
|---|---|---|
| T59832_T22 (SEQ ID NO:746) | 438 | 457 |

TABLE 44

Segment location on transcripts

| Transcript name | Segment starting position | Segment ending position |
|---|---|---|
| T59832_T6 (SEQ ID NO:742) | 1875 | 1904 |
| T59832_T8 (SEQ ID NO:743) | 1227 | 1256 |
| T59832_T11 (SEQ ID NO:744) | 781 | 810 |
| T59832_T15 (SEQ ID NO:745) | 716 | 745 |
| T59832_T22 (SEQ ID NO:746) | 458 | 487 |

Segment cluster T59832_node_34 (SEQ ID NO: 772) according to the present invention can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 45 below describes the starting and ending position of this segment on each transcript.

TABLE 45

Segment location on transcripts

| Transcript name | Segment starting position | Segment ending position |
|---|---|---|
| T59832_T6 (SEQ ID NO:742) | 1905 | 1926 |
| T59832_T8 (SEQ ID NO:743) | 1257 | 1278 |
| T59832_T11 (SEQ ID NO:744) | 811 | 832 |
| T59832_T15 (SEQ ID NO:745) | 746 | 767 |
| T59832_T22 (SEQ ID NO:746) | 488 | 509 |

Segment cluster T59832_node_35 (SEQ ID NO: 773) according to the present invention can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 46 below describes the starting and ending position of this segment on each transcript.

TABLE 46

Segment location on transcripts

| Transcript name | Segment starting position | Segment ending position |
|---|---|---|
| T59832_T6 (SEQ ID NO:742) | 1927 | 1930 |
| T59832_T8 (SEQ ID NO:743) | 1279 | 1282 |
| T59832_T11 (SEQ ID NO:744) | 833 | 836 |
| T59832_T15 (SEQ ID NO:745) | 768 | 771 |
| T59832_T22 (SEQ ID NO:746) | 510 | 513 |

Segment cluster T59832_node_36 (SEQ ID NO: 774) according to the present invention can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 47 below describes the starting and ending position of this segment on each transcript.

TABLE 47

Segment location on transcripts

| Transcript name | Segment starting position | Segment ending position |
|---|---|---|
| T59832_T6 (SEQ ID NO:742) | 1931 | 1939 |
| T59832_T8 (SEQ ID NO:743) | 1283 | 1291 |
| T59832_T11 (SEQ ID NO:744) | 837 | 845 |
| T59832_T15 (SEQ ID NO:745) | 772 | 780 |
| T59832_T22 (SEQ ID NO:746) | 514 | 522 |

Segment cluster T59832_node_37 (SEQ ID NO: 775) according to the present invention is supported by 300 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746). Table 48 below describes the starting and ending position of this segment on each transcript.

TABLE 48

Segment location on transcripts

| Transcript name | Segment starting position | Segment ending position |
|---|---|---|
| T59832_T6 (SEQ ID NO:742) | 1940 | 2039 |
| T59832_T8 (SEQ ID NO:743) | 1292 | 1391 |
| T59832_T11 (SEQ ID NO:744) | 846 | 945 |
| T59832_T15 (SEQ ID NO:745) | 781 | 880 |
| T59832_T22 (SEQ ID NO:746) | 523 | 622 |

Segment cluster T59832_node__38 (SEQ ID NO: 776) according to the present invention is supported by 247 libraries. The number of libraries was determined as previously described. This segment can be found in the following transcript(s): T59832_T6 (SEQ ID NO: 742), T59832_T8 (SEQ ID NO: 743), T59832_T11 (SEQ ID NO: 744), T59832_T15 (SEQ ID NO: 745) and T59832_T22 (SEQ ID NO. 746).

Table 49 below describes the starting and ending position of this segment on each transcript.

TABLE 49

Segment location on transcripts

| Transcript name | Segment starting position | Segment ending position |
|---|---|---|
| T59832_T6 (SEQ ID NO:742) | 2040 | 2124 |
| T59832_T8 (SEQ ID NO:743) | 1392 | 1476 |
| T59832_T11 (SEQ ID NO:744) | 946 | 1030 |
| T59832_T15 (SEQ ID NO:745) | 881 | 965 |

TABLE 49-continued

Segment location on transcripts

| Transcript name | Segment starting position | Segment ending position |
|---|---|---|
| T59832_T22 (SEQ ID NO:746) | 623 | 707 |

Variant protein alignment to the previously known protein:

Sequence name: GILT_HUMAN
Sequence documentation:

Alignment of: T59832_P7 (SEQ ID NO: 779) x GILT_HUMAN . . .
Alignment segment 1/1:
  Quality: 2110.00
Escore: 0
  Matching length: 212 Total length: 212
Matching Percent Similarity: 100.00 Matching Percent Identity: 100.00
  Total Percent Similarity: 100.00 Total Percent Identity: 100.00
  Gaps: 0
Alignment:

```
  1 MTLSPLLLFLPPLLLLLDVPTAAVQASPLQALDFFGNGPPVNYKTGNLYL  50
    |||||||||||||||||||||||||||||||||||||||||||||||||
 12 MTLSPLLLFLPPLLLLLDVPTAAVQASPLQALDFFGNGPPVNYKTGNLYL  61

51 RGPLKKSNAPLVNVTLYYEALCGGCRAFLIRELFPTWLLVMEILNVTLVP 100
    |||||||||||||||||||||||||||||||||||||||||||||||||
 62 RGPLKKSNAPLVNVTLYYEALCGGCRAFLIRELFPTWLLVMEILNVTLVP 111

101 YGNAQEQNVSGRWEFKCQHGEEECKFNKVEACVLDELDMELAFLTIVCME 150
    ||||||||||| |||||||||||||||||||||||||||||||||||||
112 YGNAQEQNVSGTWEFKCQHGEEECKFNKVEACVLDELDMELAFLTIVCME 161

151 EFEDMERSLPLCLQLYAPGLSPDTIMECAMGDRGMQLMHANAQRTDALQP 200
    |||||||||||||||||||||||||||||||||||||||||||||||||
162 EFEDMERSLPLCLQLYAPGLSPDTIMECAMGDRGMQLMHANAQRTDALQP 211

201 PHEYVPWVTVNG                                       212
    ||||||||||||
212 PHEYVPWVTVNG                                       223
```

Sequence name: GILT_HUMAN
Sequence documentation:

Alignment of: T59832_P9 (SEQ ID NO: 780) x GILT_HUMAN . . .

Alignment segment 1/1:
  Quality: 2016.00
Escore: 0
  Matching length: 203 Total length: 203
Matching Percent Similarity: 100.00 Matching Percent Identity: 100.00
  Total Percent Similarity: 100.00 Total Percent Identity: 100.00
  Gaps: 0

Alignment:

```
  1 MTLSPLLLFLPPLLLLLDVPTAAVQASPLQALDFFGNGPPVNYKTGNLYL  50
    ||||||||||||||||||||||||||||||||||||||||||||||||||
 12 MTLSPLLLFLPPLLLLLDVPTAAVQASPLQALDFFGNGPPVNYKTGNLYL  61

51 RGPLKKSNAPLVNVTLYYEALCGGCRAFLIRELFPTWLLVMEILNVTLVP 100
    ||||||||||||||||||||||||||||||||||||||||||||||||||
 62 RGPLKKSNAPLVNVTLYYEALCGGCRAFLIRELFPTWLLVMEILNVTLVP 100

101 YGNAQEQNVSGRWEFKCQHGEEECKFNKVEACVLDELDMELAFLTIVCME 150
    |||||||||||||||| |||||||||||||||||||||||||||||||||
112 YGNAQEQNVSGRWEFKVQHGEEECKFNKVEACVLDELDMELAFLTIVCME 161

151 EFEDMERSLPLCLQLYAPGLSPDTIMECAMGDRGMQLMHANAQRTDALQP 200
    ||||||||||||||||||||||||||||||||||||||||||||||||||
162 EFEDMERSLPLCLQLYAPGLSPDTIMECAMGDRGMQLMHANAQRTDALQP 211

201 PHE 203
    |||
212 PHE 214
```

Sequence name: GILT_HUMAN

Sequence documentation:

Alignment of: T59832_P12 (SEQ ID NO: 781) x GILT_HUMAN . . .

Alignment segment 1/1:
  Quality: 2084.00

Escore: 0
  Matching length: 219 Total length: 250

Matching Percent Similarity: 100.00 Matching Percent

Identity: 100.00
  Total Percent Similarity: 87.60 Total Percent

Identity: 87.60
  Gaps: 1

Alignment:

Sequence name: GILT_HUMAN

Sequence documentation:

Alignment of: T59832_P18 (SEQ ID NO: 782) x GILT_HUMAN . . .

Alignment segment 1/1:
  Quality: 1222.00

Escore: 0
  Matching length: 133 Total length: 250

Matching Percent Similarity: 100.00 Matching Percent

Identity: 100.00
  Total Percent Similarity: 53.20 Total Percent

Identity: 53.20
  Gaps: 1

```
  1 MTLSPLLLFLPPLLLLLDVPTAAVQASPLQALDFFGNGPPVNYKTGNLYL  50
    ||||||||||||||||||||||||||||||||||||||||||||||||||
 12 MTLSPLLLFLPPLLLLLDVPTAAVQASPLQALDFFGNGPPVNYKTGNLYL  61

51 RGPLKKSNAPLVNVTLYYEALCGGCRAFLIRELFPTWLLVMEILNVTLVP 100
    ||||||||||||||||||||||||||||||||||||||||||||||||||
 62 RGPLKKSNAPLVNVTLYYEALCGGCRAFLIRELFPTWLLVMEILNVTLVP 111

101 YGNAQEQNVSGRWEFLCQHGEEECKFNKVE.................... 130
    |||||||||||||||| |||||||||||||
112 YGNAQEQNVSGRWEFKCQHGEEECKFNKVEACVLDELDMELAFLTIVCME 161

131 ...........CLQLYAPGLSPDTIMECAMGDRGMQLMHANAQRTDALQP 169
               |||||||||||||||||||||||||||||||||||||||
162 EFEDMERSLPLCLQLYAPGLSPDTIMECAMGDRGMQLMHANAQRTDALQP 211

170 PHEYVPWVTVNGKPLEDQTQLLTLVCQLYQGKKPDVCPSSTSSLRSVCFK 219
    ||||||||||||||||||||||||||||||||||||||||||||||||||
212 PHEYVPWVTVNGKPLEDQTQLLTLVCQLYQGKKPDVCPSSTSSLRSVCFK 261
```

Alignment:

```
  1  MTLSPLLLFLPPLLLLLDVPTAAVQASPLQALDFFGNGPPVNYK......   44
     ||||||||||||||||||||||||||||||||||||||||||||
 12  MTLSPLLLFLPPLLLLLDVPTAAVQASPLQALDFFGNGPPVNYKTGNLYL   61

44  .................................................   44

62  RGPLKKSNAPLVNVTLYYEALCGGCRAFLIRELFPTWLLVMEILNVTLVP  111

44  .................................................   44

112  YGNAQEQNVSGRWEFKCQHGEEECKFNKVEACVLDELCMELAFLTIVCME  161

45  ...........CLQLYAPGLSPDTIMECAMGDRGMQLMHANAQRTDALQP   83
                ||||||||||||||||||||||||||||||||||||||||
162  EFEDMERSLPLCLQLYAPGLSPDTIMECAMGDRGMQLMHANAQRTDALQP  211

84  PHEYVPWVTVNGKPLEDQTQLLTLVCQLYQGKKPDVCPSSTSSLRSVCFK  133
     |||||||||||||||||||||||||||||||||||||||||||||||||
212  PHEYVPWVTVNGKPLEDQTQLLTLVCQLYQGKKPDVCPSSTSSLRSVCFK  261
```

Expression of *Homo sapiens* Interferon, Gamma-Inducible Protein 30 (IFI30) T59832 Transcripts Which are Detectable by Amplicon as Depicted in Sequence Name T59832 junc6-25-26 (SEQ ID NO:1010) in Normal and Cancerous Ovary Tissues Expression of *Homo sapiens* interferon, gamma-inducible protein 30 (IFI30) transcripts detectable by or according to junc6-25-26, T59832 junc6-25-26 (SEQ ID NO:1010) amplicon(s) and primers T59832 junc6-25-26F (SEQ ID NO:1008) and T59832 junc6-25-26R (SEQ ID NO:1009) was measured by real time PCR. In parallel the expression of four housekeeping genes—PBGD (GenBank Accession No. BC019323 (SEQ ID NO:1036); amplicon—PBGD-amplicon (SEQ ID NO:1039)), HPRT1 (GenBank Accession No. NM_000194 (SEQ ID NO: 1040); amplicon—HPRT1-amplicon (SEQ ID NO: 1044)), SDHA (GenBank Accession No. NM_004168 (SEQ ID NO:1032); amplicon—SDHA-amplicon (SEQ ID NO:1035)), and GAPDH (GenBank Accession No. BC026907; GAPDH amplicon (SEQ ID NO:1047)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45-48, 71, Table 1, above), to obtain a value of fold differential expression for each sample relative to median of the normal PM samples.

In one experiment that was carried out no differential expression in the cancerous samples relative to the normal PM samples was observed, although this may be due a problem with this specific experiment.

Primer pairs are also optionally and preferably encompassed within the present invention; for example, for the above experiment, the following primer pair was used as a non-limiting illustrative example only of a suitable primer pair: T59832 junc6-25-26F forward primer (SEQ ID NO:1008); and T59832 junc6-25-26R reverse primer (SEQ ID NO:1009).

The present invention also preferably encompasses any amplicon obtained through the use of any suitable primer pair; for example, for the above experiment, the following amplicon was obtained as a non-limiting illustrative example only of a suitable amplicon: T59832 junc6-25-26 (SEQ ID NO:1010).

Forward primer T59832 junc6-25-26F (SEQ ID NO:1008): CCACCAGTTAACTACAAGTGCCTG

Reverse primer T59832 junc6-25-26R (SEQ ID NO:1009): GCGTGCATGAGCTGCATG

Amplicon T59832junc6-25-26 (SEQ ID NO:1010): CCACCAGTTAACTACAAGTGCCTG-CAGCTCTACGCCCCAGGGCTGTCGCCAGACAC TAT-CATGGAGTGTGCAATGGGGACCGCG-GCATGCAGCTCATGCACGC

DESCRIPTION FOR CLUSTER HSCP2

Cluster HSCP2 features 12 transcript(s) and 50 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| HSCP2_PEA_1_T4 | 783 |
| HSCP2_PEA_1_T13 | 784 |
| HSCP2_PEA_1_T19 | 785 |
| HSCP2_PEA_1_T20 | 786 |
| HSCP2_PEA_1_T22 | 787 |
| HSCP2_PEA_1_T23 | 788 |
| HSCP2_PEA_1_T25 | 789 |
| HSCP2_PEA_1_T31 | 790 |
| HSCP2_PEA_1_T33 | 791 |
| HSCP2_PEA_1_T34 | 792 |
| HSCP2_PEA_1_T45 | 793 |
| HSCP2_PEA_1_T50 | 794 |

TABLE 2

Segments of interest

| Segment Name | SEQ ID NO: |
|---|---|
| HSCP2_PEA_1_node_0 | 795 |
| HSCP2_PEA_1_node_3 | 796 |
| HSCP2_PEA_1_node_6 | 797 |
| HSCP2_PEA_1_node_8 | 798 |
| HSCP2_PEA_1_node_10 | 799 |
| HSCP2_PEA_1_node_14 | 800 |

TABLE 2-continued

Segments of interest

| Segment Name | SEQ ID NO: |
|---|---|
| HSCP2_PEA_1_node_23 | 801 |
| HSCP2_PEA_1_node_26 | 802 |
| HSCP2_PEA_1_node_29 | 803 |
| HSCP2_PEA_1_node_31 | 804 |
| HSCP2_PEA_1_node_32 | 805 |
| HSCP2_PEA_1_node_34 | 806 |
| HSCP2_PEA_1_node_52 | 807 |
| HSCP2_PEA_1_node_58 | 808 |
| HSCP2_PEA_1_node_72 | 809 |
| HSCP2_PEA_1_node_73 | 810 |
| HSCP2_PEA_1_node_74 | 811 |
| HSCP2_PEA_1_node_76 | 812 |
| HSCP2_PEA_1_node_78 | 813 |
| HSCP2_PEA_1_node_80 | 814 |
| HSCP2_PEA_1_node_84 | 815 |
| HSCP2_PEA_1_node_4 | 816 |
| HSCP2_PEA_1_node_7 | 817 |
| HSCP2_PEA_1_node_13 | 818 |
| HSCP2_PEA_1_node_15 | 819 |
| HSCP2_PEA_1_node_16 | 820 |
| HSCP2_PEA_1_node_18 | 821 |
| HSCP2_PEA_1_node_20 | 822 |
| HSCP2_PEA_1_node_21 | 823 |
| HSCP2_PEA_1_node_37 | 824 |
| HSCP2_PEA_1_node_38 | 825 |
| HSCP2_PEA_1_node_39 | 826 |
| HSCP2_PEA_1_node_41 | 827 |
| HSCP2_PEA_1_node_42 | 828 |
| HSCP2_PEA_1_node_46 | 829 |
| HSCP2_PEA_1_node_47 | 830 |
| HSHSCP2_PEA_1_node_50 | 831 |
| HSCP2_PEA_1_node_51 | 832 |
| HSCP2_PEA_1_node_55 | 833 |
| HSCP2_PEA_1_node_56 | 834 |
| HSCP2_PEA_1_node_60 | 835 |
| HSCP2_PEA_1_node_61 | 836 |
| HSCP2_PEA_1_node_67 | 837 |
| HSCP2_PEA_1_node_68 | 838 |
| HSCP2_PEA_1_node_69 | 839 |
| HSCP2_PEA_1_node_70 | 840 |
| HSCP2_PEA_1_node_75 | 841 |
| HSCP2_PEA_1_node_77 | 842 |
| HSCP2_PEA_1_node_79 | 843 |
| HSCP2_PEA_1_node_82 | 844 |

TABLE 3

Proteins of interest

| Protein Name | SEQ ID NO: | Corresponding Transcript(s) |
|---|---|---|
| HSCP2_PEA_1_P4 | 846 | HSCP2_PEA_1_T4 (SEQ ID NO:783); HSCP2_PEA_1_T50 (SEQ ID NO:794) |
| HSCP2_PEA_1_P8 | 847 | HSCP2_PEA_1_T13 (SEQ ID NO:784) |
| HSCP2_PEA_1_P14 | 848 | HSCP2_PEA_1_T19 (SEQ ID NO:785) |
| HSCP2_PEA_1_P15 | 849 | HSCP2_PEA_1_T20 (SEQ ID NO:786) |
| HSCP2_PEA_1_P2 | 850 | HSCP2_PEA_1_T22 (SEQ ID NO:787) |
| HSCP2_PEA_1_P16 | 851 | HSCP2_PEA_1_T23 (SEQ ID NO:788) |
| HSCP2_PEA_1_P6 | 852 | HSCP2_PEA_1_T25 (SEQ ID NO:789) |
| HSCP2_PEA_1_P22 | 853 | HSCP2_PEA_1_T31 (SEQ ID NO:790) |
| HSCP2_PEA_1_P24 | 854 | HSCP2_PEA_1_T33 (SEQ ID NO:791) |
| HSCP2_PEA_1_P25 | 855 | HSCP2_PEA_1_T34 (SEQ ID NO:792) |
| HSCP2_PEA_1_P33 | 856 | HSCP2_PEA_1_T45 (SEQ ID NO:793) |

These sequences are variants of the known protein Ceruloplasmin precursor (SwissProt accession identifier CERU_HUMAN; known also according to the synonyms EC 1.16.3.1; Ferroxidase), SEQ ID NO: 845, referred to herein as the previously known protein.

Protein Ceruloplasmin precursor is known or believed to have the following function(s): Ceruloplasmin is a blue, copper-binding (6-7 atoms per molecule) glycoprotein found in plasma. Four possible functions are ferroxidase activity, amine oxidase activity, copper transport and homeostasis, and superoxide dismutase activity. The sequence for protein Ceruloplasmin precursor is given at the end of the application, as "Ceruloplasmin precursor amino acid sequence". Known polymorphisms for this sequence are as shown in Table 4.

TABLE 4

Amino acid mutations for Known Protein

| SNP position(s) on amino acid sequence | Comment |
|---|---|
| 79 | T -> G./FTId = VAR_001043. |
| 449 | L -> G./FTId = VAR_001044. |
| 1060 | E -> EGEYP |

The following GO Annotation(s) apply to the previously known protein. The following annotation(s) were found: ion transport; copper ion transport; copper homeostasis; iron homeostasis, which are annotation(s) related to Biological Process; ferroxidase; copper ion transporter; copper binding; oxidoreductase, which are annotation(s) related to Molecular Function; and extracellular space, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster HSCP2 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 36 refer to weighted expression of ESTs in each category, as "parts per million" (ratio of the expression of ESTs for a particular cluster to the expression of all ESTs in that category, according to parts per million).

Figure 36:
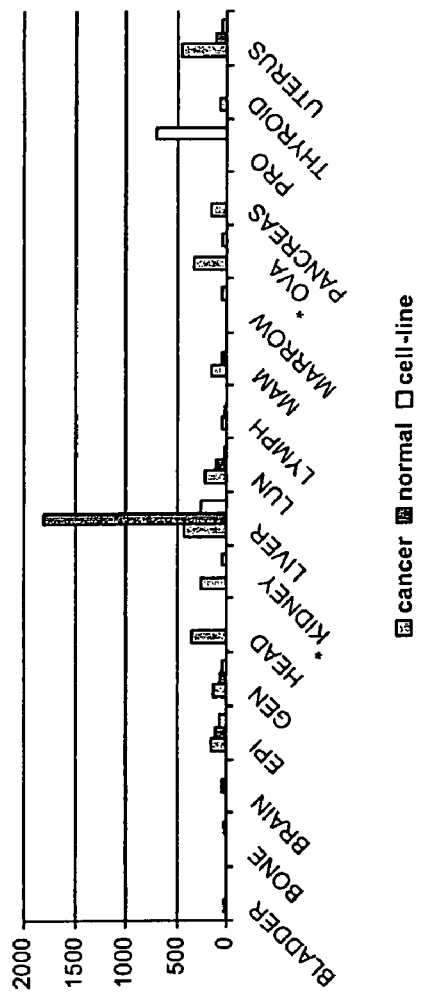
FIG. 36 shows cancer and cell-line vs. normal tissue expression.

Overall, the following results were obtained as shown with regard to the histograms in FIG. 36 and Table 5. This cluster is overexpressed (at least at a minimum level) in the following pathological conditions: kidney malignant tumors and ovarian carcinoma.

TABLE 5

Normal tissue distribution

| Name of Tissue | Number |
|---|---|
| bladder | 0 |
| bone | 9 |
| brain | 48 |
| epithelial | 100 |
| general | 58 |
| head and neck | 0 |
| kidney | 4 |
| liver | 1818 |
| lung | 96 |
| lymph nodes | 18 |
| breast | 43 |
| bone marrow | 0 |
| ovary | 0 |
| pancreas | 10 |
| prostate | 6 |
| Thyroid | 0 |
| uterus | 113 |

TABLE 6

P values and ratios for expression in cancerous tissue

| Name of Tissue | P1 | P2 | SP1 | R3 | SP2 | R4 |
|---|---|---|---|---|---|---|
| bladder | 5.4e−01 | 6.0e−01 | 5.6e−01 | 1.8 | 6.8e−01 | 1.5 |
| bone | 6.3e−01 | 8.3e−01 | 1 | 1.0 | 7.0e−01 | 1.2 |
| brain | 8.1e−01 | 8.4e−01 | 9.8e−01 | 0.3 | 1 | 0.2 |
| epithelial | 2.5e−01 | 5.8e−01 | 1.9e−03 | 1.3 | 2.4e−01 | 0.9 |
| general | 4.0e−01 | 7.6e−01 | 1.0e−08 | 1.8 | 7.4e−04 | 1.2 |
| head and neck | 2.1e−01 | 3.3e−01 | 2.1e−01 | 4.3 | 5.6e−01 | 1.9 |
| kidney | 4.0e−01 | 4.4e−01 | 2.9e−04 | 8.5 | 2.3e−03 | 6.1 |
| liver | 2.9e−01 | 8.3e−01 | 1 | 0.3 | 1 | 0.1 |
| lung | 8.4e−01 | 9.0e−01 | 4.4e−02 | 1.1 | 5.6e−01 | 0.6 |
| lymph nodes | 5.8e−01 | 8.2e−01 | 4.9e−01 | 1.8 | 8.2e−01 | 0.9 |
| breast | 3.2e−01 | 3.7e−01 | 2.3e−01 | 2.1 | 5.7e−01 | 1.3 |
| bone marrow | 1 | 6.7e−01 | 1 | 1.0 | 5.3e−01 | 1.9 |
| ovary | 7.8e−03 | 7.0e−03 | 7.0e−04 | 7.5 | 4.9e−03 | 5.6 |
| pancreas | 2.3e−01 | 4.0e−01 | 1.2e−03 | 2.5 | 9.4e−03 | 1.8 |
| prostate | 9.7e−01 | 9.3e−01 | 1 | 0.8 | 7.4e−05 | 1.3 |
| Thyroid | 5.0e−01 | 5.0e−01 | 6.7e−01 | 1.5 | 6.7e−01 | 1.5 |
| Uterus | 2.4e−01 | 1.7e−01 | 6.5e−04 | 2.1 | 7.2e−02 | 1.3 |

As noted above, cluster HSCP2 features 12 transcript(s), which were listed in Table 1 above. These transcript(s) encode for protein(s) which are variant(s) of protein Ceruloplasmin precursor. A description of each variant protein according to the present invention is now provided.

Variant protein HSCP2_PEA_1_P4 (SEQ ID NO: 846) according to the present invention has an amino acid sequence as given at the end of the application; it is encoded by transcript(s) HSCP2_PEA_1_T4 (SEQ ID NO: 783) and HSCP2_PEA_1_T50 (SEQ ID NO: 794). An alignment is given to the known protein (Ceruloplasmin precursor) at the end of the application. One or more alignments to one or more previously published protein sequences are given at the end of the application. A brief description of the relationship of the variant protein according to the present invention to each such aligned protein is as follows:

Comparison report between HSCP2_PEA_1_P4 (SEQ ID NO: 846) and CERU_HUMAN:

1. An isolated chimeric polypeptide encoding for HSCP2_PEA_1_P4 (SEQ ID NO: 846), comprising a first amino acid sequence being at least 90% homologous to MKILILGIFLFLCSTPAWAKEKHYYIGII-ETTWDYASDHGEKKLISVDTEHSNIYLQNGPD RIGR-LYKKALYLQYTDETFRTTIEKPVWLGFLGPIIKAETG DKVYVHLKNLASRPYTFHS HGITYYKEHEGAIYP-DNTTDFQRADDKVYPGEQYTYMLLATE-EQSPGEGDGNCVTRIY HSHIDAPKDIASGLIGPLIICK-KDSLDKEKEKHIDREFVVMFSVVDENFSWYLEDNI KTY CSEPEKVDKDNEDFQESNRMYSVNGYT-FGSLPGLSMCAEDRVKWYLFGMGNEVDVH AAFFH-GQALTNKNYRIDTINLFPATLFDAYMVA-QNPGEWMLSCQNLNHLKAGLQAFF QVQECNKSSSKDNIRGKHVRHYY-IAAEEIIWNYAPSGIDIFTKENLTAPGSDSAVFFEQG TTRIGGSYKKLVYREYTDASFTNRKERG-PEEEHLGILGPVIWAEVGDTIRVTFHNKGAY PLSIEPIGVRFNKNNEGTYYSPNYN-PQSRSVPPSASHVAPTETFTYEWTVPKEVGPTNAD PVCLAKMYYSAVDPTKDIFTGLIGP-MKICKKGSLHANGRQKDVDKEFYLFPTVFDENES LLLEDNIRMFTTAPDQVDKEDED-FQESNKMHSMNGFMYGNQPGLTMCKGDSVVWYL FSAGNEADVHGIYFSGNTYLWRGERRD-TANLFPQTSLTLHMWPDTEGTFNVECLTTDH YTG-GMKQKYTVNQCRRQSEDSTFYLGERTYY-IAAVEVEWDYSPQREWEKELHHLQEQ NVSNAFLDKGEFYIGSKYKKVVYRQYTD-STFRVPVERKAEEEHLGILGPQLHADVGDK VKI-IFKNMATRPYSIHAHGVQT-ESSTVTPTLPGETLTYVWKIPERSGAGTEDSACIPWAY YSTVDQVKDLYSGLIGPLIVCR-RPYLKVFNPRRKLEFALLFLVFDENESW-YLDDNIKTYS DHPEKVNKDDEEFIESNKMHAIN-GRMFGNLQGLTMHVGDEVNWYLMGMGNEIDLHT VHFHGHSFQYKHRGVYSSDVFDIFPG-TYQTLEMFPRTPGIWLLHCHVTDHIHAGMETT YTV-LQNE corresponding to amino acids 1-1060 of CERU_HUMAN, which also corresponds to amino acids 1-1060 of HSCP2_PEA_1_P4 (SEQ ID NO: 846), and a second amino acid sequence being at least 70%, optionally at least 80%, preferably at least 85%, more preferably at least 90% and most preferably at least 95% homologous to a polypeptide having the sequence GGTSM (SEQ ID NO: 1091) corresponding to amino acids 1061-1065 of HSCP2_PEA_1_P4 (SEQ ID NO: 846), wherein said first amino acid sequence and second amino acid sequence are contiguous and in a sequential order.

2. An isolated polypeptide encoding for a tail of HSCP2_PEA_1_P4 (SEQ ID NO: 846), comprising a polypeptide being at least 70%, optionally at least about 80%, preferably at least about 85%, more preferably at least about 90% and most preferably at least about 95% homologous to the sequence GGTSM (SEQ ID NO: 1091) in HSCP2_PEA_1_P4 (SEQ ID NO: 846).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCP2_PEA_1_P4 (SEQ ID NO: 846) also has the following non-silent SNPs (Single Nucleotide Polymorphisms) as listed in Table 7 (given according to their position(s) on the amino acid sequence, with the alternative amino acid(s) listed; the last column indicates whether the SNP is known or not; the presence of known SNPs in variant protein HSCP2_PEA_1_P4 (SEQ ID NO: 846) sequence provides support for the deduced sequence of this variant protein according to the present invention).

TABLE 7

Amino acid mutations

| SNP position(s) on amino acid sequence | Alternative amino acid(s) | Previously known SNP? |
|---|---|---|
| 26 | I -> | No |
| 29 | I -> | No |
| 37 | S -> P | No |
| 47 | V -> | No |
| 54 | I -> V | No |
| 63 | I -> | No |
| 92 | F -> S | No |
| 117 | Y -> N | No |
| 148 | K -> R | No |
| 173 | N -> | No |
| 186 | P -> | No |
| 190 | A -> | No |
| 190 | A -> G | No |
| 213 | I -> | No |
| 218 | V -> M | No |
| 221 | F -> | No |
| 235 | N -> D | No |
| 253 | F -> L | No |
| 275 | M -> T | No |
| 286 | F -> L | No |
| 298 | F -> S | No |
| 305 | T -> A | No |
| 445 | H -> Y | No |
| 451 | P -> A | No |
| 477 | P -> L | No |
| 493 | P -> | No |
| 507 | S -> P | No |
| 535 | L -> P | No |
| 544 | D -> E | Yes |
| 584 | V -> A | No |
| 598 | R -> K | Yes |
| 607 | V -> G | Yes |
| 640 | D -> G | No |
| 660 | F -> S | No |
| 675 | A -> | No |
| 711 | Q -> | No |
| 727 | F -> S | No |
| 748 | Q -> | No |
| 759 | Q -> | No |
| 759 | Q -> P | No |
| 789 | D -> N | No |
| 927 | E -> K | Yes |
| 1040 | C -> W | No |

The glycosylation sites of variant protein HSCP2_PEA_1_P4 (SEQ ID NO: 846), as compared to the known protein Ceruloplasmin precursor, are described in Table 8 (given according to their position(s) on the amino acid sequence in the first column; the second column indicates whether the glycosylation site is present in the variant protein; and the last column indicates whether the position is different on the variant protein).

TABLE 8

Glycosylation site(s)

| Position(s) on known amino acid sequence | Present in variant protein? | Position in variant protein? |
|---|---|---|
| 138 | yes | 138 |
| 762 | yes | 762 |
| 397 | yes | 397 |
| 358 | yes | 358 |

Variant protein HSCP2_PEA_1_P4 (SEQ ID NO: 846) is encoded by the following transcript(s): HSCP2_PEA_1_T4 (SEQ ID NO: 783) and HSCP2_PEA_1_T50 (SEQ ID NO: 794), for which the sequence(s) is/are given at the end of the application.

The coding portion of transcript HSCP2_PEA_1_T4 (SEQ ID NO: 783) is shown in bold; this coding portion starts at position 250 and ends at position 3444. The transcript also has the following SNPs as listed in Table 9 (given according to their position on the nucleotide sequence, with the alternative nucleic acid listed; the last column indicates whether the SNP is known or not; the presence of known SNPs in variant protein HSCP2_PEA_1_P4 (SEQ ID NO: 846) sequence provides support for the deduced sequence of this variant protein according to the present invention).

TABLE 9

Nucleic acid SNPs

| SNP position on nucleotide sequence | Alternative nucleic acid | Previously known SNP? |
|---|---|---|
| 63 | A -> | No |
| 201 | G -> T | No |
| 326 | T -> | No |
| 335 | T -> | No |
| 358 | T -> C | No |
| 360 | T -> C | No |
| 389 | T -> | No |
| 409 | A -> G | No |
| 437 | T -> | No |
| 524 | T -> C | No |
| 591 | T -> C | No |
| 598 | T -> A | No |
| 692 | A -> G | No |
| 768 | T -> | No |
| 807 | A -> | No |
| 807 | A -> G | No |
| 818 | C -> | No |
| 818 | C -> G | No |
| 837 | T -> C | No |
| 887 | T -> | No |
| 901 | G -> A | No |
| 910 | T -> | No |
| 952 | A -> G | No |
| 1006 | T -> C | No |
| 1053 | A -> G | Yes |
| 1073 | T -> C | No |
| 1107 | T -> G | No |
| 1142 | T -> C | No |
| 1162 | A -> G | No |
| 1284 | A -> G | No |
| 1287 | C -> T | No |
| 1353 | G -> A | No |
| 1582 | C -> T | No |
| 1600 | C -> G | No |
| 1617 | G -> A | No |
| 1679 | C -> T | No |
| 1728 | A -> | No |
| 1768 | T -> C | No |
| 1851 | T -> C | No |
| 1853 | T -> C | No |
| 1881 | T -> A | Yes |
| 1938 | A -> G | No |
| 2000 | T -> C | No |
| 2042 | G -> A | Yes |
| 2055 | T -> C | No |
| 2069 | T -> G | Yes |
| 2139 | T -> C | No |
| 2168 | A -> G | No |
| 2199 | A -> C | Yes |
| 2228 | T -> C | No |
| 2274 | A -> | No |
| 2364 | C -> T | No |
| 2381 | A -> | No |
| 2429 | T -> C | No |
| 2492 | A -> | No |
| 2525 | A -> | No |
| 2525 | A -> C | No |

TABLE 9-continued

Nucleic acid SNPs

| SNP position on nucleotide sequence | Alternative nucleic acid | Previously known SNP? |
|---|---|---|
| 2614 | G -> A | No |
| 3028 | G -> A | Yes |
| 3240 | T -> C | No |
| 3276 | A -> G | No |
| 3369 | C -> G | No |
| 5131 | C -> A | Yes |
| 6091 | T -> | No |
| 6106 | A -> C | Yes |
| 6366 | G -> A | No |
| 6564 | G -> A | Yes |

The coding portion of transcript HSCP2_PEA_1_T50 (SEQ ID NO: 794) is shown in bold; this coding portion starts at position 250 and ends at position 3444. The transcript also has the following SNPs as listed in Table 10 (given according to their position on the nucleotide sequence, with the alternative nucleic acid listed; the last column indicates whether the SNP is known or not; the presence of known SNPs in variant protein HSCP2_PEA_1_P4 (SEQ ID NO: 846) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 63 | A -> | No |
| 201 | G -> T | No |
| 326 | T -> | No |
| 335 | T -> | No |
| 358 | T -> C | No |
| 360 | T -> C | No |
| 389 | T -> | No |
| 409 | A -> G | No |
| 437 | T -> | No |
| 524 | T -> C | No |
| 591 | T -> C | No |
| 598 | T -> A | No |
| 692 | A -> G | No |
| 768 | T -> | No |
| 807 | A -> | No |
| 807 | A -> G | No |
| 818 | C -> | No |
| 818 | C -> G | No |
| 837 | T -> C | No |
| 887 | T -> | No |
| 901 | G -> A | No |
| 910 | T -> | No |
| 952 | A -> G | No |
| 1006 | T -> C | No |
| 1053 | A -> G | Yes |
| 1073 | T -> C | No |
| 1107 | T -> G | No |
| 1142 | T -> C | No |
| 1162 | A -> G | No |
| 1284 | A -> G | No |
| 1287 | C -> T | No |
| 1353 | G -> A | No |
| 1582 | C -> T | No |
| 1600 | C -> G | No |
| 1617 | G -> A | No |
| 1679 | C -> T | No |
| 1728 | A -> | No |
| 1768 | T -> C | No |
| 1851 | T -> C | No |
| 1853 | T -> C | No |

TABLE 10-continued

Nucleic acid SNPs

| SNP position on nucleotide sequence | Alternative nucleic acid | Previously known SNP? |
|---|---|---|
| 1881 | T -> A | Yes |
| 1938 | A -> G | No |
| 2000 | T -> C | No |
| 2042 | G -> A | Yes |
| 2055 | T -> C | No |
| 2069 | T -> G | Yes |
| 2139 | T -> C | No |
| 2168 | A -> G | No |
| 2199 | A -> C | Yes |
| 2228 | T -> C | No |
| 2274 | A -> | No |
| 2364 | C -> T | No |
| 2381 | A -> | No |
| 2429 | T -> C | No |
| 2492 | A -> | No |
| 2525 | A -> | No |
| 2525 | A -> C | No |
| 2614 | G -> A | No |
| 3028 | G -> A | Yes |
| 3240 | T -> C | No |
| 3276 | A -> G | No |
| 3369 | C -> G | No |

Variant protein HSCP2_PEA_1_P8 (SEQ ID NO: 847) according to the present invention has an amino acid sequence as given at the end of the application; it is encoded by transcript(s) HSCP2_PEA_1_T13 (SEQ ID NO: 784). An alignment is given to the known protein (Ceruloplasmin precursor) at the end of the application. One or more alignments to one or more previously published protein sequences are given at the end of the application. A brief description of the relationship of the variant protein according to the present invention to each such aligned protein is as follows:

Comparison report between HSCP2_PEA_1_P8 (SEQ ID NO: 847) and CERU_HUMAN:

1. An isolated chimeric polypeptide encoding for HSCP2_PEA_1_P8 (SEQ ID NO: 847), comprising a first amino acid sequence being at least 90% homologous to MKILILGIFLFLCSTPAWAKEKHYYIGII-ETTWDYASDHGEKKLISVDTEHSNIYLQNGPD RIGR-LYKKALYLQYTDETFRTTIEKPVWLGFLGPIIKAETG DKVYVHLKNLASRPYTFHS HGITYYKEHEGAIYP-DNTTDFQRADDKVYPGEQYTYMLLATE-EQSPGEGDGNCVTRIY HSHIDAPKDIASGLIGPLIICK-KDSLDKEKEKHIDREFVVMFSVVDENFSWYLEDNIK TY CSEPEKVDKDNEDFQESNRMYSVNGYT-FGSLPGLSMCAEDRVKWYLFGMGNEVDVH AAFFH-GQALTNKNYRIDTINLFPATLFDAYMVA-QNPGEWMLSCQNLNHLKAGLQAFF QVQECNKSSSKDNIRGKHVRHYY-IAAEEIIWNYAPSGIDIFTKENLTAPGSDSAVFFEQG TTRIGGSYKKLVYREYTDASFTNRKERG-PEEEHLGILGPVIWAEVGDTIRVTFHNKGAY PLSIEPIGVRFNKNNEGTYYSPNYN-PQSRSVPPSASHVAPTETFTYEWTVPKEVGPTNAD PVCLAKMYYSAVDPTKDIFTGLIGP-MKICKKGSLHANGRQKDVDKEFYLFPTVFDENES LLLEDNIRMFTTAPDQVDKEDED-FQESNKMHSMNGFMYGNQPGLTMCKGDSVVWYL FSAGNEADVHGIYFSGNTYLWRGERRD-TANLFPQTSLTLHMWPDTEGTFNVECLTTDH YTG-GMKQKYTVNQCRRQSEDSTFYLGERTYY-IAAVEVEWDYSPQREWEKELHHLQEQ NVSNAFLDKGEFYIGSKYKKVVYRQYTD-
STFRVPVERKAEEEHLGILGPQLHADVGDK VKI-
IFKNMATRPYSIHAHGVQT-
ESSTVTPTLPGETLTYVWKIPERSGAGTEDSACIPWAY
YSTVDQVKDLYSGLIGPLIVCR-
RPYLKVFNPRRKLEFALLFLVFDENESW-
YLDDNIKTYS DHPEKVNKDDEEFIESNKMHAIN-
GRMFGNLQGLTMHVGDEVNWYLMGMGNEIDLHT
VHFHGHSFQYK corresponding to amino acids 1-1006 of CERU_HUMAN, which also corresponds to amino acids 1-1006 of HSCP2_PEA__1_P8 (SEQ ID NO: 847), and a second amino acid sequence being at least 70%, optionally at least 80%, preferably at least 85%, more preferably at least 90% and most preferably at least 95% homologous to a polypeptide having the sequence KCFQEHLEFGYSTAM (SEQ ID NO: 1092) corresponding to amino acids 1007-1021 of HSCP2_PEA__1_P8 (SEQ ID NO: 847), wherein said first amino acid sequence and second amino acid sequence are contiguous and in a sequential order.

2. An isolated polypeptide encoding for a tail of HSCP2_PEA__1_P8 (SEQ ID NO: 847), comprising a polypeptide being at least 70%, optionally at least about 80%, preferably at least about 85%, more preferably at least about 90% and most preferably at least about 95% homologous to the sequence KCFQEHLEFGYSTAM (SEQ ID NO: 1092) in HSCP2_PEA__1_P8 (SEQ ID NO: 847).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCP2_PEA__1_P8 (SEQ ID NO: 847) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein HSCP2_PEA__1_P8 (SEQ ID NO: 847) sequence provides support for the deduced sequence of this variant protein according to the present invention).

TABLE 11

Amino acid mutations

| SNP position(s) on amino acid sequence | Alternative amino acid(s) | Previously known SNP? |
|---|---|---|
| 26 | I -> | No |
| 29 | I -> | No |
| 37 | S -> P | No |
| 47 | V -> | No |
| 54 | I -> V | No |
| 63 | I -> | No |
| 92 | F -> S | No |
| 117 | Y -> N | No |
| 148 | K -> R | No |
| 173 | N -> | No |
| 186 | P -> | No |
| 190 | A -> | No |
| 190 | A -> G | No |
| 213 | I -> | No |
| 218 | V -> M | No |
| 221 | F -> | No |
| 235 | N -> D | No |

TABLE 11-continued

Amino acid mutations

| SNP position(s) on amino acid sequence | Alternative amino acid(s) | Previously known SNP? |
|---|---|---|
| 253 | F -> L | No |
| 275 | M -> T | No |
| 286 | F -> L | No |
| 298 | F -> S | No |
| 305 | T -> A | No |
| 445 | H -> Y | No |
| 451 | P -> A | No |
| 477 | P -> L | No |
| 493 | P -> | No |
| 507 | S -> P | No |
| 535 | L -> P | No |
| 544 | D -> E | Yes |
| 584 | V -> A | No |
| 598 | R -> K | Yes |
| 607 | V -> G | Yes |
| 640 | D -> G | No |
| 660 | F -> S | No |
| 675 | A -> | No |
| 711 | Q -> | No |
| 727 | F -> S | No |
| 748 | Q -> | No |
| 759 | Q -> | No |
| 759 | Q -> P | No |
| 789 | D -> N | No |
| 927 | E -> K | Yes |
| 1020 | A -> G | No |

The glycosylation sites of variant protein HSCP2_PEA__1_P8 (SEQ ID NO: 847), as compared to the known protein Ceruloplasmin precursor, are described in Table 12 (given according to their position(s) on the amino acid sequence in the first column; the second column indicates whether the glycosylation site is present in the variant protein; and the last column indicates whether the position is different on the variant protein).

TABLE 12

Glycosylation site(s)

| Position(s) on known amino acid sequence | Present in variant protein? | Position in variant protein? |
|---|---|---|
| 138 | yes | 138 |
| 762 | yes | 762 |
| 397 | yes | 397 |
| 358 | yes | 358 |

Variant protein HSCP2_PEA__1_P8 (SEQ ID NO: 847) is encoded by the following transcript(s): HSCP2_PEA__1_T13 (SEQ ID NO: 784), for which the sequence(s) is/are given at the end of the application. The coding portion of transcript HSCP2_PEA__1_T13 (SEQ ID NO: 784) is shown in bold; this coding portion starts at position 250 and ends at position 3312. The transcript also has the following SNPs as listed in Table 13 (given according to their position on the nucleotide sequence, with the alternative nucleic acid listed; the last column indicates whether the SNP is known or not; the presence of known SNPs in variant protein HSCP2_PEA__1_P8 (SEQ ID NO: 847) sequence provides support for the deduced sequence of this variant protein according to the present invention).

TABLE 13

Nucleic acid SNPs

| SNP position on nucleotide sequence | Alternative nucleic acid | Previously known SNP? |
|---|---|---|
| 63 | A -> | No |
| 201 | G -> T | No |
| 326 | T -> | No |
| 335 | T -> | No |
| 358 | T -> C | No |
| 360 | T -> C | No |
| 389 | T -> | No |
| 409 | A -> G | No |
| 437 | T -> | No |
| 524 | T -> C | No |
| 591 | T -> C | No |
| 598 | T -> A | No |
| 692 | A -> G | No |
| 768 | T -> | No |
| 807 | A -> | No |
| 807 | A -> G | No |
| 818 | C -> | No |
| 818 | C -> G | No |
| 837 | T -> C | No |
| 887 | T -> | No |
| 901 | G -> A | No |
| 910 | T -> | No |
| 952 | A -> G | No |
| 1006 | T -> C | No |
| 1053 | A -> G | Yes |
| 1073 | T -> C | No |
| 1107 | T -> G | No |
| 1142 | T -> C | No |
| 1162 | A -> G | No |
| 1284 | A -> G | No |
| 1287 | C -> T | No |
| 1353 | G -> A | No |
| 1582 | C -> T | No |
| 1600 | C -> G | No |
| 1617 | G -> A | No |
| 1679 | C -> T | No |
| 1728 | A -> | No |
| 1768 | T -> C | No |
| 1851 | T -> C | No |
| 1853 | T -> C | No |
| 1881 | T -> A | Yes |
| 1938 | A -> G | No |
| 2000 | T -> C | No |
| 2042 | G -> A | Yes |
| 2055 | T -> C | No |
| 2069 | T -> G | Yes |
| 2139 | T -> C | No |
| 2168 | A -> G | No |
| 2199 | A -> C | Yes |
| 2228 | T -> C | No |
| 2274 | A -> | No |
| 2364 | C -> T | No |
| 2381 | A -> | No |
| 2429 | T -> C | No |
| 2492 | A -> | No |
| 2525 | A -> | No |
| 2525 | A -> C | No |
| 2614 | G -> A | No |
| 3028 | G -> A | Yes |
| 3240 | T -> C | No |
| 3308 | C -> G | No |
| 3880 | T -> | No |
| 3895 | A -> C | Yes |
| 4155 | G -> A | No |
| 4353 | G -> A | Yes |

Variant protein HSCP2_PEA_1_P14 (SEQ ID NO: 848) according to the present invention has an amino acid sequence as given at the end of the application; it is encoded by transcript(s) HSCP2_PEA_1_T19 (SEQ ID NO: 785). An alignment is given to the known protein (Ceruloplasmin precursor) at the end of the application. One or more alignments to one or more previously published protein sequences are given at the end of the application. A brief description of the relationship of the variant protein according to the present invention to each such aligned protein is as follows:

Comparison report between HSCP2_PEA_1_P14 (SEQ ID NO: 848) and CERU_HUMAN:

1. An isolated chimeric polypeptide encoding for HSCP2_PEA_1_P14 (SEQ ID NO: 848), comprising a first amino acid sequence being at least 90% homologous to MKI-LILGIFLFLCSTPAWAKEKHYYIGII-ETTWDYASDHGEKKLISVDTEHSNIYLQNGPD RIGR-LYKKALYLQYTDETFRTTIEKPVWLGFLGPIIKAETG DKVYVHLKNLASRPYTFHS HGITYYKEHEGAIYP-DNTTDFQRADDKVYPGEQYTYMLLATE-EQSPGEGDGNCVTRIY HSHIDAPKDIASGLIGPLIICK-KDSLDKEKEKHIDREFVVMFSVVDENFSWYLEDNIKTY CSEPEKVDKDNEDFQESNRMYSVNGYT-FGSLPGLSMCAEDRVKWYLFGMGNEVDVH AAFFH-GQALTNKNYRIDTINLFPATLFDAYMVA-QNPGEWMLSCQNLNHLKAGLQAFF QVQECNKSSSKDNIRGKHVRHYY-IAAEEIIWNYAPSGIDIFTKENLTAPGSDSAVFFEQG TTRIGGSYKKLVYREYTDASFTNRKERG-PEEEHLGILGPVIWAEVGDTIRVTFHNKGAY PLSIEPIGVRFNKNNEGTYYSPNYN-PQSRSVPPSASHVAPTETFTYEWTVPKEVGPTNAD PVCLAKMYYSAVDPTKDIFTGLIGP-MKICKKGSLHANGRQKDVDKEFYLFPTVFDENES LLLEDNIRMFTTAPDQVDKEDEDFQESNKMH corresponding to amino acids 1-621 of CERU_HUMAN, which also corresponds to amino acids 1-621 of HSCP2_PEA_1_P14 (SEQ ID NO: 848), a second amino acid sequence bridging amino acid sequence comprising of W, and a third amino acid sequence being at least 90% homologous to TFN-VECLTTDHYTGGMKQKYTVNQCRRQSED-STFYLGERTYYIAAVEVEWDYSPQRE WEKEL-HHLQEQNVSNAFLDKGEFYIGSKYKKVVYRQYTDS TFRVPVERKAEEEHLGIL GPQLHADVGDKVKIIFKN-MATRPYSIHAHGVQT-ESSTVTPTLPGETLTYVWKIPERSGA GTEDSACIP-WAYYSTVDQVKDLYSGLIGPLIVCRRPYLKVFNPRR KLEFALLFLVFDENE SWYLDDNIKTYSDHPE-KVNKDDEEFIESNKMHAINGRMFGN-LQGLTMHVGDEVNWYL MGMGNEIDLHTVHFHGH-SFQYKHRGVYSSDVFDIFPGTYQTLEMFPRTPGIWLL HCHV TDHIHAGMETTYTVLQNEDTKSG corresponding to amino acids 694-1065 of CERU_HUMAN, which also corresponds to amino acids 623-994 of HSCP2_PEA_1_P14 (SEQ ID NO: 848), wherein said first amino acid sequence, second amino acid sequence and third amino acid sequence are contiguous and in a sequential order.

2. An isolated polypeptide encoding for an edge portion of HSCP2_PEA_1_P14 (SEQ ID NO: 848), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise HWT having a structure as follows (numbering according to HSCP2_PEA_1_P14 (SEQ ID NO: 848)): a sequence starting from any of amino acid numbers 621-x to 621; and ending at any of amino acid numbers 623+((n-2)-x), in which x varies from 0 to n-2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCP2_PEA_1_P14 (SEQ ID NO: 848) also has the following non-silent SNPs (Single Nucleotide Polymorphisms) as listed in Table 14, (given according to their position(s) on the amino acid sequence, with the alternative amino acid(s) listed; the last column indicates whether the SNP is known or not; the presence of known SNPs in variant protein HSCP2_PEA_1_P14 (SEQ ID NO: 848) sequence provides support for the deduced sequence of this variant protein according to the present invention).

TABLE 14

Amino acid mutations

| SNP position(s) on amino acid sequence | Alternative amino acid(s) | Previously known SNP? |
|---|---|---|
| 26 | I -> | No |
| 29 | I -> | No |
| 37 | S -> P | No |
| 47 | V -> | No |
| 54 | I -> V | No |
| 63 | I -> | No |
| 92 | F -> S | No |
| 117 | Y -> N | No |
| 148 | K -> R | No |
| 173 | N -> | No |
| 186 | P -> | No |
| 190 | A -> | No |
| 190 | A -> G | No |
| 213 | I -> | No |
| 218 | V -> M | No |
| 221 | F -> | No |
| 235 | N -> D | No |
| 253 | F -> L | No |
| 275 | M -> T | No |
| 286 | F -> L | No |
| 298 | F -> S | No |
| 305 | T -> A | No |
| 445 | H -> Y | No |
| 451 | P -> A | No |
| 477 | P -> L | No |
| 493 | P -> | No |
| 507 | S -> P | No |
| 535 | L -> P | No |
| 544 | D -> E | Yes |
| 584 | V -> A | No |
| 598 | R -> K | Yes |
| 607 | V -> G | Yes |
| 640 | Q -> | No |
| 656 | F -> S | No |
| 677 | Q -> | No |
| 688 | Q -> | No |
| 688 | Q -> P | No |
| 718 | D -> N | No |
| 856 | E -> K | Yes |
| 969 | C -> W | No |

The glycosylation sites of variant protein HSCP2_PEA_1_P14 (SEQ ID NO: 848), as compared to the known protein Ceruloplasmin precursor, are described in Table 15 (given according to their position(s) on the amino acid sequence in the first column; the second column indicates whether the glycosylation site is present in the variant protein; and the last column indicates whether the position is different on the variant protein).

TABLE 15

Glycosylation site(s)

| Position(s) on known amino acid sequence | Present in variant protein? | Position in variant protein? |
|---|---|---|
| 138 | yes | 138 |
| 762 | yes | 691 |
| 397 | yes | 397 |
| 358 | yes | 358 |

Variant protein HSCP2_PEA_1_P14 (SEQ ID NO: 848) is encoded by the following transcript(s): HSCP2_PEA_1_T19 (SEQ ID NO: 785), for which the sequence(s) is/are given at the end of the application. The coding portion of transcript HSCP2_PEA_1_T19 (SEQ ID NO: 785) is shown in bold; this coding portion starts at position 250 and ends at position 3231. The transcript also has the following SNPs as listed in Table 16 (given according to their position on the nucleotide sequence, with the alternative nucleic acid listed; the last column indicates whether the SNP is known or not; the presence of known SNPs in variant protein HSCP2_PEA_1_P14 (SEQ ID NO: 848) sequence provides support for the deduced sequence of this variant protein according to the present invention).

TABLE 16

Nucleic acid SNPs

| SNP position on nucleotide sequence | Alternative nucleic acid | Previously know SNP? |
|---|---|---|
| 63 | A -> | No |
| 201 | G -> T | No |
| 326 | T -> | No |
| 335 | T -> | No |
| 358 | T -> C | No |
| 360 | T -> C | No |
| 389 | T -> | No |
| 409 | A -> G | No |
| 437 | T -> | No |
| 524 | T -> C | No |
| 591 | T -> C | No |
| 598 | T -> A | No |
| 692 | A -> G | No |
| 768 | T -> | No |
| 807 | A -> | No |
| 807 | A -> G | No |
| 818 | C -> | No |
| 818 | C -> G | No |
| 837 | T -> C | No |
| 887 | T -> | No |
| 901 | G -> A | No |
| 910 | T -> | No |
| 952 | A -> G | No |
| 1006 | T -> C | No |
| 1053 | A -> G | Yes |
| 1073 | T -> C | No |
| 1107 | T -> G | No |
| 1142 | T -> C | No |
| 1162 | A -> G | No |
| 1284 | A -> G | No |
| 1287 | C -> T | No |
| 1353 | G -> A | No |
| 1582 | C -> T | No |
| 1600 | C -> G | No |
| 1617 | G -> A | No |
| 1679 | C -> T | No |
| 1728 | A -> | No |
| 1768 | T -> C | No |
| 1851 | T -> C | No |
| 1853 | T -> C | No |
| 1881 | T -> A | Yes |
| 1938 | A -> G | No |

TABLE 16-continued

Nucleic acid SNPs

| SNP position on nucleotide sequence | Alternative nucleic acid | Previously know SNP? |
|---|---|---|
| 2000 | T -> C | No |
| 2042 | G -> A | Yes |
| 2055 | T -> C | No |
| 2069 | T -> G | Yes |
| 2151 | C -> T | No |
| 2168 | A -> | No |
| 2216 | T -> C | No |
| 2279 | A -> | No |
| 2312 | A -> | No |
| 2312 | A -> C | No |
| 2401 | G -> A | No |
| 2815 | G -> A | Yes |
| 3027 | T -> C | No |
| 3063 | A -> G | No |
| 3156 | C -> G | No |
| 3728 | T -> | No |
| 3743 | A -> C | Yes |
| 4003 | G -> A | No |
| 4201 | G -> A | Yes |

Variant protein HSCP2_PEA_1_P15 (SEQ ID NO: 849) according to the present invention has an amino acid sequence as given at the end of the application; it is encoded by transcript(s) HSCP2_PEA_1_T20 (SEQ ID NO: 786). An alignment is given to the known protein (Ceruloplasmin precursor) at the end of the application. One or more alignments to one or more previously published protein sequences are given at the end of the application. A brief description of the relationship of the variant protein according to the present invention to each such aligned protein is as follows:

Comparison report between HSCP2_PEA_1_P15 (SEQ ID NO: 849) and CERU_HUMAN:

1. An isolated chimeric polypeptide encoding for HSCP2_PEA_1_P15 (SEQ ID NO: 849), comprising a first amino acid sequence being at least 90% homologous to MKILILGIFLFLCSTPAWAKEKHYYIGII-ETTWDYASDHGEKKLISVDTEHSNIYLQNGPD RIGR-LYKKALYLQYTDETFRTTIEKPVWLGFLGPIIKAETG DKVYVHLKNLASRPYTFHS HGITYYKEHEGAIYP-DNTTDFQRADDKVYPGEQYTYMLLATE-EQSPGEGDGNCVTRIY HSHIDAPKDIASGLIGPLIICK-KDSLDKEKEKHIDREFVVMFSVVDENFSWYLEDNI KTY CSEPEKVDKDNEDFQESNRMYSVNGYT-FGSLPGLSMCAEDRVKWYLFGMGNEVDVH AAFFH-GQALTNKNYRIDTINLFPATLFDAYMVA-QNPGEWMLSCQNLNHLKAGLQAFF QVQECNKSSSKDNIRGKHVRHYY-IAAEEIIWNYAPSGIDIFTKENLTAPGSDSAVFFEQG TTRIGGSYKKLVYREYTDASFTNRKERG-PEEEHLGILGPVIWAEVGDTIRVTFHNKGAY PLSIEPIGVRFNKNNEGTYYSPNYN-PQSRSVPPSASHVAPTETFTYEWTVPKEVGPTNAD PVCLAKMYYSAVDPTKDIFTGLIGP-MKICKKGSLHANGRQKDVDKEFYLFPTVFDENES LLLEDNIRMFTTAPDQVDKEDED-FQESNKMHSMNGFMYGNQPGLTMCKGDSVVWYL FSAGNEADVHGIYFSGNTYLWRGERRD-TANLFPQTSLTLHMWPDTEGTFNVECLTTDH YTG-GMKQKYTVNQCRRQSEDSTFYLGERTYY-IAAVEVEWDYSPQREWEKELHHLQEQ NVSNAFLDKGEFYIGSKYKKVVYRQYTD-STFRVPVERKAEEEHLGILGPQLHADVGDK VKI-IFKNMATRPYSIHAHGVQT-ESSTVTPTLPGETLTYVWKIPERSGAGTEDSACIPWAY YSTVDQVKDLYSGLIGPLIVCR-RPYLKVFNPRRKLEFALLFLVFDENESW-YLDDNIKTYS DHPEKVNKDDEEFIESNKMHAIN-GRMFGNLQGLTMHVGDEVNWYLMGMGNEIDLHT VHFHGHSFQYKHRGVYSSDVFDIFPG-TYQTLEMFPRTPGIWLLHCHVTDHIHAGMETT YTV-LQNE corresponding to amino acids 1-1060 of CERU_HUMAN, which also corresponds to amino acids 1-1060 of HSCP2_PEA_1_P15 (SEQ ID NO: 849), and a second amino acid sequence being at least 70%, optionally at least 80%, preferably at least 85%, more preferably at least 90% and most preferably at least 95% homologous to a polypeptide having the sequence GEYPASSETHRRIWNVIYP-ITVSVIILFQISTKE (SEQ ID NO: 1093) corresponding to amino acids 1061-1094 of HSCP2_PEA_1_P15 (SEQ ID NO: 849), wherein said first amino acid sequence and second amino acid sequence are contiguous and in a sequential order.

2. An isolated polypeptide encoding for a tail of HSCP2_PEA_1_P15 (SEQ ID NO: 849), comprising a polypeptide being at least 70%, optionally at least about 80%, preferably at least about 85%, more preferably at least about 90% and most preferably at least about 95% homologous to the sequence GEYPASSETHRRIWNVIYPITVSVIILF-QISTKE (SEQ ID NO: 1093) in HSCP2_PEA_1_P15 (SEQ ID NO: 849).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCP2_PEA_1_P15 (SEQ ID NO: 849) also has the following non-silent SNPs (Single Nucleotide Polymorphisms) as listed in Table 17, (given according to their position(s) on the amino acid sequence, with the alternative amino acid(s) listed; the last column indicates whether the SNP is known or not; the presence of known SNPs in variant protein HSCP2_PEA_1_P15 (SEQ ID NO: 849) sequence provides support for the deduced sequence of this variant protein according to the present invention).

TABLE 17

Amino acid mutations

| SNP position(s) on amino acid sequence | Alternative amino acid(s) | Previously known SNP? |
|---|---|---|
| 26 | I -> | No |
| 29 | I -> | No |
| 37 | S -> P | No |
| 47 | V -> | No |
| 54 | I -> V | No |
| 63 | I -> | No |
| 92 | F -> S | No |
| 117 | Y -> N | No |
| 148 | K -> R | No |
| 173 | N -> | No |
| 186 | P -> | No |
| 190 | A -> | No |
| 190 | A -> G | No |
| 213 | I -> | No |
| 218 | V -> M | No |
| 221 | F -> | No |
| 235 | N -> D | No |

TABLE 17-continued

Amino acid mutations

| SNP position(s) on amino acid sequence | Alternative amino acid(s) | Previously known SNP? |
|---|---|---|
| 253 | F -> L | No |
| 275 | M -> T | No |
| 286 | F -> L | No |
| 298 | F -> S | No |
| 305 | T -> A | No |
| 445 | H -> Y | No |
| 451 | P -> A | No |
| 477 | P -> L | No |
| 493 | P -> | No |
| 507 | S -> P | No |
| 535 | L -> P | No |
| 544 | D -> E | Yes |
| 584 | V -> A | No |
| 598 | R -> K | Yes |
| 607 | V -> G | Yes |
| 640 | D -> G | No |
| 660 | F -> S | No |
| 675 | A -> | No |
| 711 | Q -> | No |
| 727 | F -> S | No |
| 748 | Q -> | No |
| 759 | Q -> | No |
| 759 | Q -> P | No |
| 789 | D -> N | No |
| 927 | E -> K | Yes |
| 1040 | C -> W | No |

The glycosylation sites of variant protein HSCP2_PEA_1_P15 (SEQ ID NO: 849), as compared to the known protein Ceruloplasmin precursor, are described in Table 18 (given according to their position(s) on the amino acid sequence in the first column; the second column indicates whether the glycosylation site is present in the variant protein; and the last column indicates whether the position is different on the variant protein).

TABLE 18

Glycosylation site(s)

| Position(s) on known amino acid sequence | Present in variant protein? | Position in variant protein? |
|---|---|---|
| 138 | yes | 138 |
| 762 | yes | 762 |
| 397 | yes | 397 |
| 358 | yes | 358 |

Variant protein HSCP2_PEA_1_P15 (SEQ ID NO: 849) is encoded by the following transcript(s): HSCP2_PEA_1_T20 (SEQ ID NO: 786), for which the sequence(s) is/are given at the end of the application. The coding portion of transcript HSCP2_PEA_1_T20 (SEQ ID NO: 786) is shown in bold; this coding portion starts at position 250 and ends at position 3531. The transcript also has the following SNPs as listed in Table 19 (given according to their position on the nucleotide sequence, with the alternative nucleic acid listed; the last column indicates whether the SNP is known or not; the presence of known SNPs in variant protein HSCP2_PEA_1_P15 (SEQ ID NO: 849) sequence provides support for the deduced sequence of this variant protein according to the present invention).

TABLE 19

Nucleic acid SNPs

| SNP position on nucleotide sequence | Alternative nucleic acid | Previously known SNP? |
|---|---|---|
| 63 | A -> | No |
| 201 | G -> T | No |
| 326 | T -> | No |
| 335 | T -> | No |
| 358 | T -> C | No |
| 360 | T -> C | No |
| 389 | T -> | No |
| 409 | A -> G | No |
| 437 | T -> | No |
| 524 | T -> C | No |
| 591 | T -> C | No |
| 598 | T -> A | No |
| 692 | A -> G | No |
| 768 | T -> | No |
| 807 | A -> | No |
| 807 | A -> G | No |
| 818 | C -> | No |
| 818 | C -> G | No |
| 837 | T -> C | No |
| 887 | T -> | No |
| 901 | G -> A | No |
| 910 | T -> | No |
| 952 | A -> G | No |
| 1006 | T -> C | No |
| 1053 | A -> G | Yes |
| 1073 | T -> C | No |
| 1107 | T -> G | No |
| 1142 | T -> C | No |
| 1162 | A -> G | No |
| 1284 | A -> G | No |
| 1287 | C -> T | No |
| 1353 | G -> A | No |
| 1582 | C -> T | No |
| 1600 | C -> G | No |
| 1617 | G -> A | No |
| 1679 | C -> T | No |
| 1728 | A -> | No |
| 1768 | T -> C | No |
| 1851 | T -> C | No |
| 1853 | T -> C | No |
| 1881 | T -> A | Yes |
| 1938 | A -> G | No |
| 2000 | T -> C | No |
| 2042 | G -> A | Yes |
| 2055 | T -> C | No |
| 2069 | T -> G | Yes |
| 2139 | T -> C | No |
| 2168 | A -> G | No |
| 2199 | A -> C | Yes |
| 2228 | T -> C | No |
| 2274 | A -> | No |
| 2364 | C -> T | No |
| 2381 | A -> | No |
| 2429 | T -> C | No |
| 2492 | A -> | No |
| 2525 | A -> | No |
| 2525 | A -> C | No |
| 2614 | G -> A | No |
| 3028 | G -> A | Yes |
| 3240 | T -> C | No |
| 3276 | A -> G | No |
| 3369 | C -> G | No |
| 3623 | T -> | Yes |
| 3828 | G -> T | No |
| 3978 | T -> | No |
| 3979 | C -> | No |

Variant protein HSCP2_PEA_1_P2 (SEQ ID NO: 850) according to the present invention has an amino acid sequence as given at the end of the application; it is encoded by transcript(s) HSCP2_PEA_1_T22 (SEQ ID NO: 787). An alignment is given to the known protein (Ceruloplasmin precursor) at the end of the application. One or more alignments to one or more previously published protein sequences are given at the end of the application. A brief description of the relationship of the variant protein according to the present invention to each such aligned protein is as follows:

Comparison report between HSCP2_PEA_1_P2 (SEQ ID NO: 850) and CERU_HUMAN:

1. An isolated chimeric polypeptide encoding for HSCP2_PEA_1_P2 (SEQ ID NO: 850), comprising a first amino acid sequence being at least 90% homologous to MKILILGIFLFLCSTPAWAKEKHYYIGII-ETTWDYASDHGEKKLISVDTEHSNIYLQNGPD RIGR-LYKKALYLQYTDETFRTTIEKPVWLGFLGPIIKAETG DKVYVHLKNLASRPYTFHS HGITYYKEHEGAIYP-DNTTDFQRADDKVYPGEQYTYMLLATE-EQSPGEGDGNCVTRIY HSHIDAPKDIASGLIGPLIICK-KDSLDKEKEKHIDREFVVMFSVVDENFSWYLEDNI KTY CSEPEKVDKDNEDFQESNRMYSVNGYT-FGSLPGLSMCAEDRVKWYLFGMGNEVDVH AAFFH-GQALTNKNYRIDTINLFPATLFDAYMVA-QNPGEWMLSCQNLNHLKAGLQAFF QVQECNKSSSKDNIRGKHVRHYY-IAAEEIIWNYAPSGIDIFTKENLTAPGSDSAVFFEQG TTRIGGSYKKLVYREYTDASFTNRKERG-PEEEHLGILGPVIWAEVGDTIRVTFHNKGAY PLSIEPIGVRFNKNNEGTYYSPNYN-PQSRSVPPSASHVAPTETFTYEWTVPKEVGPTNAD PVCLAKMYYSAVDPTKDIFTGLIGP-MKICKKGSLHANGRQKDVDKEFYLFPTVFDENES LLLEDNIRMFTTAPDQVDKEDED-FQESNKMHSMNGFMYGNQPGLTMCKGDSVVWYL FSAGNEADVHGIYFSGNTYLWRGERRD-TANLFPQTSLTLHMWPDTEGTFNVECLTTDH YTG-GMKQKYTVNQCRRQSEDSTFYLGERTYY-IAAVEVEWDYSPQREWEKELHHLQEQ corresponding to amino acids 1-761 of CERU_HUMAN, which also corresponds to amino acids 1-761 of HSCP2_PEA_1_P2 (SEQ ID NO: 850), and a second amino acid sequence being at least 70%, optionally at least 80%, preferably at least 85%, more preferably at least 90% and most preferably at least 95% homologous to a polypeptide having the sequence K corresponding to amino acids 762-762 of HSCP2_PEA_1_P2 (SEQ ID NO: 850), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCP2_PEA_1_P2 (SEQ ID NO: 850) also has the following non-silent SNPs (Single Nucleotide Polymorphisms) as listed in Table 20, (given according to their position(s) on the amino acid sequence, with the alternative amino acid(s) listed; the last column indicates whether the SNP is known or not; the presence of known SNPs in variant protein HSCP2_PEA_1_P2 (SEQ ID NO: 850) sequence provides support for the deduced sequence of this variant protein according to the present invention).

TABLE 20

Amino acid mutations

| SNP position(s) on amino acid sequence | Alternative amino acid(s) | Previously known SNP? |
| --- | --- | --- |
| 26 | I -> | No |
| 29 | I -> | No |
| 37 | S -> P | No |
| 47 | V -> | No |
| 54 | I -> V | No |
| 63 | I -> | No |
| 92 | F -> S | No |
| 117 | Y -> N | No |
| 148 | K -> R | No |
| 173 | N -> | No |
| 186 | P -> | No |
| 190 | A -> | No |
| 190 | A -> G | No |
| 213 | I -> | No |
| 218 | V -> M | No |
| 221 | F -> | No |
| 235 | N -> D | No |
| 253 | F -> L | No |
| 275 | M -> T | No |
| 286 | F -> L | No |
| 298 | F -> S | No |
| 305 | T -> A | No |
| 445 | H -> Y | No |
| 451 | P -> A | No |
| 477 | P -> L | No |
| 493 | P -> | No |
| 507 | S -> P | No |
| 535 | L -> P | No |
| 544 | D -> E | Yes |
| 584 | V -> A | No |
| 598 | R -> K | Yes |
| 607 | V -> G | Yes |
| 640 | D -> G | No |
| 660 | F -> S | No |
| 675 | A -> | No |
| 711 | Q -> | No |
| 727 | F -> S | No |
| 748 | Q -> | No |
| 759 | Q -> | No |
| 759 | Q -> P | No |

The glycosylation sites of variant protein HSCP2_PEA_1_P2 (SEQ ID NO: 850), as compared to the known protein Ceruloplasmin precursor, are described in Table 21 (given according to their position(s) on the amino acid sequence in the first column; the second column indicates whether the glycosylation site is present in the variant protein; and the last column indicates whether the position is different on the variant protein).

TABLE 21

Glycosylation site(s)

| Position(s) on known amino acid sequence | Present in variant protein? | Position in variant protein? |
| --- | --- | --- |
| 138 | yes | 138 |
| 762 | no | |
| 397 | yes | 397 |
| 358 | yes | 358 |

Variant protein HSCP2_PEA_1_P2 (SEQ ID NO: 850) is encoded by the following transcript(s): HSCP2_PEA_1_T22 (SEQ ID NO: 787), for which the sequence(s) is/are given at the end of the application. The coding portion of transcript HSCP2_PEA_1_T22 (SEQ ID NO: 787) is shown in bold; this coding portion starts at position 250 and ends at position 2535. The transcript also has the following SNPs as listed in Table 22 (given according to their position on the nucleotide sequence, with the alternative nucleic acid listed; the last column indicates whether the SNP is known or not; the presence of known SNPs in variant protein HSCP2_PEA_1_P2 (SEQ ID NO: 850) sequence provides support for the deduced sequence of this variant protein according to the present invention).

TABLE 22

Nucleic acid SNPs

| SNP position on nucleotide sequence | Alternative nucleic acid | Previously known SNP? |
|---|---|---|
| 63 | A -> | No |
| 201 | G -> T | No |
| 326 | T -> | No |
| 335 | T -> | No |
| 358 | T -> C | No |
| 360 | T -> C | No |
| 389 | T -> | No |
| 409 | A -> G | No |
| 437 | T -> | No |
| 524 | T -> C | No |
| 591 | T -> C | No |
| 598 | T -> A | No |
| 692 | A -> G | No |
| 768 | T -> | No |
| 807 | A -> | No |
| 807 | A -> G | No |
| 818 | C -> | No |
| 818 | C -> G | No |
| 837 | T -> C | No |
| 887 | T -> | No |
| 901 | G -> A | No |
| 910 | T -> | No |
| 952 | A -> G | No |
| 1006 | T -> C | No |
| 1053 | A -> G | Yes |
| 1073 | T -> C | No |
| 1107 | T -> G | No |
| 1142 | T -> C | No |
| 1162 | A -> G | No |
| 1284 | A -> G | No |
| 1287 | C -> T | No |
| 1353 | G -> A | No |
| 1582 | C -> T | No |
| 1600 | C -> G | No |
| 1617 | G -> A | No |
| 1679 | C -> T | No |
| 1728 | A -> | No |
| 1768 | T -> C | No |
| 1851 | T -> C | No |
| 1853 | T -> C | No |
| 1881 | T -> A | Yes |
| 1938 | A -> G | No |
| 2000 | T -> C | No |
| 2042 | G -> A | Yes |
| 2055 | T -> C | No |
| 2069 | T -> G | Yes |
| 2139 | T -> C | No |
| 2168 | A -> G | No |
| 2199 | A -> C | Yes |
| 2228 | T -> C | No |
| 2274 | A -> | No |
| 2364 | C -> T | No |
| 2381 | A -> | No |
| 2429 | T -> C | No |
| 2492 | A -> | No |
| 2525 | A -> | No |
| 2525 | A -> C | No |
| 2565 | A -> | No |
| 2676 | G -> A | No |
| 3195 | T -> A | Yes |
| 3482 | G -> A | Yes |
| 3542 | A -> G | No |
| 3975 | G -> A | No |

Variant protein HSCP2_PEA_1_P16 (SEQ ID NO: 851) according to the present invention has an amino acid sequence as given at the end of the application; it is encoded by transcript(s) HSCP2_PEA_1_T23 (SEQ ID NO: 788). An alignment is given to the known protein (Ceruloplasmin precursor) at the end of the application. One or more alignments to one or more previously published protein sequences are given at the end of the application. A brief description of the relationship of the variant protein according to the present invention to each such aligned protein is as follows:

Comparison report between HSCP2_PEA_1_P16 (SEQ ID NO: 851) and CERU_HUMAN:

1. An isolated chimeric polypeptide encoding for HSCP2_PEA_1_P16 (SEQ ID NO: 851), comprising a first amino acid sequence being at least 90% homologous to MKILILGIFLFLCSTPAWAKEKHYYIGII-ETTWDYASDHGEKKLISVDTEHSNIYLQNGPD RIGR-LYKKALYLQYTDETFRTTIEKPVWLGFLGPIIKAETG DKVYVHLKNLASRPYTFHS HGITYYKEHEGAIYP-DNTTDFQRADDKVYPGEQYTYMLLATE-EQSPGEGDGNCVTRIY HSHIDAPKDIASGLIGPLIICK-KDSLDKEKEKHIDREFVVMFSVVDENFSWYLEDNI KTY CSEPEKVDKDNEDFQESNRMYSVNGYT-FGSLPGLSMCAEDRVKWYLFGMGNEVDVH AAFFH-GQALTNKNYRIDTINLFPATLFDAYMVA-QNPGEWMLSCQNLNHLKAGLQAFF QVQECNKSSSKDNIRGKHVRHYY-IAAEEIIWNYAPSGIDIFTKENLTAPGSDSAVFFEQG TTRIGGSYKKLVYREYTDASFTNRKERG-PEEEHLGILGPVIWAEVGDTIRVTFHNKGAY PLSIEPIGVRFNKNNEGTYYSPNYN-PQSRSVPPSASHVAPTETFTYEWTVPKEVGPTNAD PVCLAKMYYSAVDPTKDIFTGLIGP-MKICKKGSLHANGRQKDVDKEFYLFPTVFDENES LLLEDNIRMFTTAPDQVDKEDED-FQESNKMHSMNGFMYGNQPGLTMCKGDSVVWYL FSAGNEADVHGIYFSGNTYLWRGERRD-TANLFPQTSLTLHMWPDTEGTFNVECLTTDH YTG-GMKQKYTVNQCRRQSEDSTFYLGERTYY-IAAVEVEWDYSPQREWEKELHHLQEQ NVSNAFLDKGEFYIGSKYKKVVYRQYTD-STFRVPVERKAEEEHLGILGPQLHADVGDK VKI-IFKNMATRPYSIHAHGVQT-ESSTVTPTLPGETLTYVWKIPERSGAGTEDSACIPWAY YSTVDQVKDLYSGLIGPLIVCR-RPYLKVFNPRRKLEFALLFLVFDENESW-YLDDNIKTYS DHPEKVNKDDEEFIESNKMHAIN-GRMFGNLQGLTMHVGDEVNWYLMGMGNEIDLHT VHFHGHSFQYKH corresponding to amino acids 1-1007 of CERU_HUMAN, which also corresponds to amino acids 1-1007 of HSCP2_PEA_1_P16 (SEQ ID NO: 851), and a second amino acid sequence being at least 70%, optionally at least 80%, preferably at least 85%, more preferably at least 90% and most preferably at least 95% homologous to a polypeptide having the sequence LLRLTGEYGM (SEQ ID NO: 1094) corresponding to amino acids 1008-1017 of HSCP2_PEA_1_P16 (SEQ ID NO: 851), wherein said first amino acid sequence and second amino acid sequence are contiguous and in a sequential order.

2. An isolated polypeptide encoding for a tail of HSCP2_PEA_1_P16 (SEQ ID NO: 851), comprising a polypeptide being at least 70%, optionally at least about 80%, preferably at least about 85%, more preferably at least about 90% and most preferably at least about 95% homologous to the sequence LLRLTGEYGM (SEQ ID NO: 1094) in HSCP2_PEA_1_P16 (SEQ ID NO: 851).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCP2_PEA_1_P16 (SEQ ID NO: 851) also has the following non-silent SNPs (Single Nucleotide Polymorphisms) as listed in Table 23 (given according to their position(s) on the amino acid sequence, with the alternative amino acid(s) listed; the last column indicates whether the SNP is known or not; the presence of known SNPs in variant protein HSCP2_PEA_1_P16 (SEQ ID NO: 851) sequence provides support for the deduced sequence of this variant protein according to the present invention).

TABLE 23

Amino acid mutations

| SNP position(s) on amino acid sequence | Alternative amino acid(s) | Previously known SNP? |
| --- | --- | --- |
| 26 | I -> | No |
| 29 | I -> | No |
| 37 | S -> P | No |
| 47 | V -> | No |
| 54 | I -> V | No |
| 63 | I -> | No |
| 92 | F -> S | No |
| 117 | Y -> N | No |
| 148 | K -> R | No |
| 173 | N -> | No |
| 186 | P -> | No |
| 190 | A -> G | No |
| 190 | A -> | No |
| 213 | I -> | No |
| 218 | V -> M | No |
| 221 | F -> | No |
| 235 | N -> D | No |
| 253 | F -> L | No |
| 275 | M -> T | No |
| 286 | F -> L | No |
| 298 | F -> S | No |
| 305 | T -> A | No |
| 445 | H -> Y | No |
| 451 | P -> A | No |
| 477 | P -> L | No |
| 493 | P -> | No |
| 507 | S -> P | No |
| 535 | L -> P | No |
| 544 | D -> E | Yes |
| 584 | V -> A | No |
| 598 | R -> K | Yes |
| 607 | V -> G | Yes |
| 640 | D -> G | No |
| 660 | F -> S | No |
| 675 | A -> | No |
| 711 | Q -> | No |
| 727 | F -> S | No |
| 748 | Q -> | No |
| 759 | Q -> | No |
| 759 | Q -> P | No |
| 789 | D -> N | No |
| 927 | E -> K | Yes |

The glycosylation sites of variant protein HSCP2_PEA_1_P16 (SEQ ID NO: 851), as compared to the known protein Ceruloplasmin precursor, are described in Table 24 (given according to their position(s) on the amino acid sequence in the first column; the second column indicates whether the glycosylation site is present in the variant protein; and the last column indicates whether the position is different on the variant protein).

TABLE 24

| Glycosylation site(s) | | |
| --- | --- | --- |
| Position(s) on known amino acid sequence | Present in variant protein? | Position in variant protein? |
| 138 | yes | 138 |
| 762 | yes | 762 |
| 397 | yes | 397 |
| 358 | yes | 358 |

Variant protein HSCP2_PEA_1_P16 (SEQ ID NO: 851) is encoded by the following transcript(s): HSCP2_PEA_1_T23 (SEQ ID NO: 788), for which the sequence(s) is/are given at the end of the application. The coding portion of transcript HSCP2_PEA_1_T23 (SEQ ID NO: 788) is shown in bold; this coding portion starts at position 250 and ends at position 3300. The transcript also has the following SNPs as listed in Table 25 (given according to their position on the nucleotide sequence, with the alternative nucleic acid listed; the last column indicates whether the SNP is known or not; the presence of known SNPs in variant protein HSCP2_PEA_1_P16 (SEQ ID NO: 851) sequence provides support for the deduced sequence of this variant protein according to the present invention).

TABLE 25

| Nucleic acid SNPs | | |
| --- | --- | --- |
| SNP position on nucleotide sequence | Alternative nucleic acid | Previously known SNP? |
| 63 | A -> | No |
| 201 | G -> T | No |
| 326 | T -> | No |
| 335 | T -> | No |
| 358 | T -> C | No |
| 360 | T -> C | No |
| 389 | T -> | No |
| 409 | A -> G | No |
| 437 | T -> | No |
| 524 | T -> C | No |
| 591 | T -> C | No |
| 598 | T -> A | No |
| 692 | A -> G | No |
| 768 | T -> | No |
| 807 | A -> | No |
| 807 | A -> G | No |
| 818 | C -> | No |
| 818 | C -> G | No |
| 837 | T -> C | No |
| 887 | T -> | No |
| 901 | G -> A | No |
| 910 | T -> | No |
| 952 | A -> G | No |
| 1006 | T -> C | No |
| 1053 | A -> G | Yes |
| 1073 | T -> C | No |
| 1107 | T -> G | No |
| 1142 | T -> C | No |
| 1162 | A -> G | No |
| 1284 | A -> G | No |
| 1287 | C -> T | No |
| 1353 | G -> A | No |
| 1582 | C -> T | No |
| 1600 | C -> G | No |
| 1617 | G -> A | No |
| 1679 | C -> T | No |
| 1728 | A -> | No |
| 1768 | T -> C | No |

TABLE 25-continued

Nucleic acid SNPs

| SNP position on nucleotide sequence | Alternative nucleic acid | Previously known SNP? |
|---|---|---|
| 1851 | T -> C | No |
| 1853 | T -> C | No |
| 1881 | T -> A | Yes |
| 1938 | A -> G | No |
| 2000 | T -> C | No |
| 2042 | G -> A | Yes |
| 2055 | T -> C | No |
| 2069 | T -> G | Yes |
| 2139 | T -> C | No |
| 2168 | A -> G | No |
| 2199 | A -> C | Yes |
| 2228 | T -> C | No |
| 2274 | A -> | No |
| 2364 | C -> T | No |
| 2381 | A -> | No |
| 2429 | T -> C | No |
| 2492 | A -> | No |
| 2525 | A -> | No |
| 2525 | A -> C | No |
| 2614 | G -> A | No |
| 3028 | G -> A | Yes |
| 3240 | T -> C | No |
| 3448 | T -> | Yes |
| 3653 | G -> T | No |
| 3803 | T -> | No |
| 3804 | C -> | No |

Variant protein HSCP2_PEA_1_P6 (SEQ ID NO: 852) according to the present invention has an amino acid sequence as given at the end of the application; it is encoded by transcript(s) HSCP2_PEA_1_T25 (SEQ ID NO: 789). An alignment is given to the known protein (Ceruloplasmin precursor) at the end of the application. One or more alignments to one or more previously published protein sequences are given at the end of the application. A brief description of the relationship of the variant protein according to the present invention to each such aligned protein is as follows:

Comparison report between HSCP2_PEA_1_P6 (SEQ ID NO: 852) and CERU_HUMAN:

1. An isolated chimeric polypeptide encoding for HSCP2_PEA_1_P6 (SEQ ID NO: 852), comprising a first amino acid sequence being at least 90% homologous to MKI-LILGIFLFLCSTPAWAKEKHYYIGII-ETTWDYASDHGEKKLISVDTEHSNIYLQNGPD RIGR-LYKKALYLQYTDETFRTTIEKPVWLGFLGPIIKAETG DKVYVHLKNLASRPYTFHS HGITYYKEHEGAIYP-DNTTDFQRADDKVYPGEQYTYMLLATE-EQSPGEGDGNCVTRIY HSHIDAPKDIASGLIGPLIICK-KDSLDKEKEKHIDREFVVMFSVVDENFSWYLEDNIK TY CSEPEKVDKDNEDFQESNRMYSVNGYT-FGSLPGLSMCAEDRVKWYLFGMGNEVDVH AAFFH-GQALTNKNYRIDTINLFPATLFDAYMVA-QNPGEWMLSCQNLNHLKAGLQAFF QVQECNKSSSKDNIRGKHVRHYY-IAAEEIIWNYAPSGIDIFTKENLTAPGSDSAVFFEQG TTRIGGSYKKLVYREYTDASFTNRKERG-PEEEHLGILGPVIWAEVGDTIRVTFHNKGAY PLSIEPIGVRFNKNNEGTYYSPNYN-PQSRSVPPSASHVAPTETFTYEWTVPKEVGPTNAD PVCLAKMYYSAVDPTKDIFTGLIGP-MKICKKGSLHANGRQKDVDKEFYLFPTVFDENES LLLEDNIRMFTTAPDQVDKEDED-FQESNKMHSMNGFMYGNQPGLTMCKGDSVVWYL FSAGNEADVHGIYFSGNTYLWRGERRD-TANLFPQTSLTLHMWPDTEGTFNVECLTTDH YTG-GMKQKYTVNQCRRQSEDSTFYLGERTYY-IAAVEVEWDYSPQREWEKELHHLQEQ NVSNAFLDKGEFYIGSKYKKVVYRQYTD-STFRVPVERKAEEEHLGILGPQLHADVGDK VKI-IFKNMATRPYSIHAHGVQT-ESSTVTPTLPGETLTYVWKIPERSGAGTEDSACIPWAY YSTVDQVKDLYSGLIGPLIVCR-RPYLKVFNPRRKLEFALLFLVFDENESW-YLDDNIKTYS DHPEKVNKDDEEFIESNKMHAIN-GRMFGNLQGLTMHVGDEVNWYLMGMGNEIDLHT VHFHGHSFQYK corresponding to amino acids 1-1006 of CERU_HUMAN, which also corresponds to amino acids 1-1006 of HSCP2_PEA_1_P6 (SEQ ID NO: 852), and a second amino acid sequence being at least 70%, optionally at least 80%, preferably at least 85%, more preferably at least 90% and most preferably at least 95% homologous to a polypeptide having the sequence GSL corresponding to amino acids 1007-1009 of HSCP2_PEA_1_P6 (SEQ ID NO: 852), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCP2_PEA_1_P6 (SEQ ID NO: 852) also has the following non-silent SNPs (Single Nucleotide Polymorphisms) as listed in Table 26, (given according to their position(s) on the amino acid sequence, with the alternative amino acid(s) listed; the last column indicates whether the SNP is known or not; the presence of known SNPs in variant protein HSCP2_PEA_1_P6 (SEQ ID NO: 852) sequence provides support for the deduced sequence of this variant protein according to the present invention).

TABLE 26

Amino acid mutations

| SNP position(s) on amino acid sequence | Alternative amino acid(s) | Previously known SNP? |
|---|---|---|
| 26 | I -> | No |
| 29 | I -> | No |
| 37 | S -> P | No |
| 47 | V -> | No |
| 54 | I -> V | No |
| 63 | I -> | No |
| 92 | F -> S | No |
| 117 | Y -> N | No |
| 148 | K -> R | No |
| 173 | N -> | No |
| 186 | P -> | No |
| 190 | A -> | No |
| 190 | A -> G | No |
| 213 | I -> | No |
| 218 | V -> M | No |
| 221 | F -> | No |
| 235 | N -> D | No |
| 253 | F -> L | No |
| 275 | M -> T | No |
| 286 | F -> L | No |
| 298 | F -> S | No |
| 305 | T -> A | No |
| 445 | H -> Y | No |
| 451 | P -> A | No |
| 477 | P -> L | No |

TABLE 26-continued

Amino acid mutations

| SNP position(s) on amino acid sequence | Alternative amino acid(s) | Previously known SNP? |
|---|---|---|
| 493 | P -> | No |
| 507 | S -> P | No |
| 535 | L -> P | No |
| 544 | D -> E | Yes |
| 584 | V -> A | No |
| 598 | R -> K | Yes |
| 607 | V -> G | Yes |
| 640 | D -> G | No |
| 660 | F -> S | No |
| 675 | A -> | No |
| 711 | Q -> | No |
| 727 | F -> S | No |
| 748 | Q -> | No |
| 759 | Q -> | No |
| 759 | Q -> P | No |
| 789 | D -> N | No |
| 927 | E -> K | Yes |
| 1008 | S -> G | No |

The glycosylation sites of variant protein HSCP2_PEA_1_P6 (SEQ ID NO: 852), as compared to the known protein Ceruloplasmin precursor, are described in Table 27 (given according to their position(s) on the amino acid sequence in the first column; the second column indicates whether the glycosylation site is present in the variant protein; and the last column indicates whether the position is different on the variant protein).

TABLE 27

Glycosylation site(s)

| Position(s) on known amino acid sequence | Present in variant protein? | Position in variant protein? |
|---|---|---|
| 138 | yes | 138 |
| 762 | yes | 762 |
| 397 | yes | 397 |
| 358 | yes | 358 |

Variant protein HSCP2_PEA_1_P6 (SEQ ID NO: 852) is encoded by the following transcript(s): HSCP2_PEA_1_T25 (SEQ ID NO: 789), for which the sequence(s) is/are given at the end of the application. The coding portion of transcript HSCP2_PEA_1_T25 (SEQ ID NO: 789) is shown in bold; this coding portion starts at position 250 and ends at position 3276. The transcript also has the following SNPs as listed in Table 28 (given according to their position on the nucleotide sequence, with the alternative nucleic acid listed; the last column indicates whether the SNP is known or not; the presence of known SNPs in variant protein HSCP2_PEA_1_P6 (SEQ ID NO: 852) sequence provides support for the deduced sequence of this variant protein according to the present invention).

TABLE 28

Nucleic acid SNPs

| SNP position on nucleotide sequence | Alternative nucleic acid | Previously known SNP? |
|---|---|---|
| 63 | A -> | No |
| 201 | G -> T | No |
| 326 | T -> | No |
| 335 | T -> | No |
| 358 | T -> C | No |
| 360 | T -> C | No |
| 389 | T -> | No |
| 409 | A -> G | No |
| 437 | T -> | No |
| 524 | T -> C | No |
| 591 | T -> C | No |
| 598 | T -> A | No |
| 692 | A -> G | No |
| 768 | T -> | No |
| 807 | A -> | No |
| 807 | A -> G | No |
| 818 | C -> | No |
| 818 | C -> G | No |
| 837 | T -> C | No |
| 887 | T -> | No |
| 901 | G -> A | No |
| 910 | T -> | No |
| 952 | A -> G | No |
| 1006 | T -> C | No |
| 1053 | A -> G | Yes |
| 1073 | T -> C | No |
| 1107 | T -> G | No |
| 1142 | T -> C | No |
| 1162 | A -> G | No |
| 1284 | A -> G | No |
| 1287 | C -> T | No |
| 1353 | G -> A | No |
| 1582 | C -> T | No |
| 1600 | C -> G | No |
| 1617 | G -> A | No |
| 1679 | C -> T | No |
| 1728 | A -> | No |
| 1768 | T -> C | No |
| 1851 | T -> C | No |
| 1853 | T -> C | No |
| 1881 | T -> A | Yes |
| 1938 | A -> G | No |
| 2000 | T -> C | No |
| 2042 | G -> A | Yes |
| 2055 | T -> C | No |
| 2069 | T -> G | Yes |
| 2139 | T -> C | No |
| 2168 | A -> G | No |
| 2199 | A -> C | Yes |
| 2228 | T -> C | No |
| 2274 | A -> | No |
| 2364 | C -> T | No |
| 2381 | A -> | No |
| 2429 | T -> C | No |
| 2492 | A -> | No |
| 2525 | A -> | No |
| 2525 | A -> C | No |
| 2614 | G -> A | No |
| 3028 | G -> A | Yes |
| 3240 | T -> C | No |
| 3271 | A -> G | No |
| 3364 | C -> G | No |

Variant protein HSCP2_PEA_1_P2 (SEQ ID NO: 850)2 according to the present invention has an amino acid sequence as given at the end of the application; it is encoded by transcript(s) HSCP2_PEA_1_T31 (SEQ ID NO: 790). An alignment is given to the known protein (Ceruloplasmin precursor) at the end of the application. One or more alignments to one or more previously published protein sequences are given at the end of the application. A brief description of the relationship of the variant protein according to the present invention to each such aligned protein is as follows:

Comparison report between HSCP2_PEA_1_P2 (SEQ ID NO: 850)2 and CERU_HUMAN:

1. An isolated chimeric polypeptide encoding for HSCP2_PEA_1_P2 (SEQ ID NO: 850)2, comprising a first amino acid sequence being at least 90% homologous to MKILILGIFLFLCSTPAWAKEKHYYIGII-ETTWDYASDHGEKKLISVDTEHSNIYLQNGPD RIGR-LYKKALYLQYTDETFRTTIEKPVWLGFLGPIIKAETG DKVYVHLKNLASRPYTFHS HGITYYKEHE corresponding to amino acids 1-131 of CERU_HUMAN, which also corresponds to amino acids 1-131 of HSCP2_PEA_1_P22 (SEQ ID NO: 853), a second amino acid sequence bridging amino acid sequence comprising of A, and a third amino acid sequence being at least 90% homologous to VNGYTFGSLPGLSMCAEDRVKWYLFG-MGNEVDVHAAFFHGQALTNKNYRIDTINLFP ATLF-DAYMVAQNPGEWMLSCQNLNHLKA-GLQAFFQVQECNKSSSKDNIRGKHVRHY YIAAEEIIWNYAPSGIDIFTKENL-TAPGSDSAVFFEQGTTRIGGSYKKLVYREYTDASFTN RKERGPEEEHLGILGPVIWAE-VGDTIRVTFHNKGAYPLSIEPIGVR-FNKNNEGTYYSPNY NPQSRSVPPSASHVAPTET-FTYEWTVPKEVGPTNADPVCLAKMYYSAVDPTKDIF TGLI GPMKICKKGSLHANGRQKDVDKEFYLF-PTVFDENESLLLEDNIRMFTTAPDQVDKEDE DFQESNKMHSMNGFMYGNQPGLTMCK-GDSVVWYLFSAGNEADVHGIYFSGNTYLWR GER-RDTANLFPQTSLTLHMWPDTEGTFNVE-CLTTDHYTGGMKQKYTVNQCRRQSEDS TFYLGERTYYIAAVEVEWDYS-PQREWEKELHHLQEQNVSNAFLDKGE-FYIGSKYKKVV YRQYTDSTFRVPVERKAEEE-HLGILGPQLHADVGDKVKIIFKNMATRPYSIHAHGV QTE SSTVTPTLPGETLTYVWKIPERSGAGT-EDSACIPWAYYSTVDQVKDLYSGLIGPLIVCRR PYLKVFNPRRKLEFALLFLVFDENESW-YLDDNIKTYSDHPEKVNKDDEEFIESNKMHAI NGRMFGNLQGLTMHVGDEVNWYLMGMG-NEIDLHTVHFHGHSFQYKHRGVYSSDVF DIFPGTYQ-TLEMFPRTPGIWLLHCHVTDHIHAGMET-TYTVLQNEDTKSG corresponding to amino acids 262-1065 of CERU_HUMAN, which also corresponds to amino acids 133-936 of HSCP2_PEA_1_P22 (SEQ ID NO: 853), wherein said first amino acid sequence, second amino acid sequence and third amino acid sequence are contiguous and in a sequential order.

2. An isolated polypeptide encoding for an edge portion of HSCP2_PEA_1_P22 (SEQ ID NO: 853), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EAV having a structure as follows (numbering according to HSCP2_PEA_1_P22 (SEQ ID NO: 853)): a sequence starting from any of amino acid numbers 131–x to 131; and ending at any of amino acid numbers 133+((n–2)–x), in which x varies from 0 to n–2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCP2_PEA_1_P22 (SEQ ID NO: 853) also has the following non-silent SNPs (Single Nucleotide Polymorphisms) as listed in Table 29, (given according to their position(s) on the amino acid sequence, with the alternative amino acid(s) listed; the last column indicates whether the SNP is known or not; the presence of known SNPs in variant protein HSCP2_PEA_1_P22 (SEQ ID NO: 853) sequence provides support for the deduced sequence of this variant protein according to the present invention).

TABLE 29

Amino acid mutations

| SNP position(s) on amino acid sequence | Alternative amino acid(s) | Previously known SNP? |
|---|---|---|
| 26 | I -> | No |
| 29 | I -> | No |
| 37 | S -> P | No |
| 47 | V -> | No |
| 54 | I -> V | No |
| 63 | I -> | No |
| 92 | F -> S | No |
| 117 | Y -> N | No |
| 146 | M -> T | No |
| 157 | F -> L | No |
| 169 | F -> S | No |
| 176 | T -> A | No |
| 316 | H -> Y | No |
| 322 | P -> A | No |
| 348 | P -> L | No |
| 364 | P -> | No |
| 378 | S -> P | No |
| 406 | L -> P | No |
| 415 | D -> E | Yes |
| 455 | V -> A | No |
| 469 | R -> K | Yes |
| 478 | V -> G | Yes |
| 511 | D -> G | No |
| 531 | F -> S | No |
| 546 | A -> | No |
| 582 | Q -> | No |
| 598 | F -> S | No |
| 619 | Q -> | No |
| 630 | Q -> P | No |
| 630 | Q -> | No |
| 660 | D -> N | No |
| 798 | E -> K | Yes |
| 911 | C -> W | No |

The glycosylation sites of variant protein HSCP2_PEA_1_P22 (SEQ ID NO: 853), as compared to the known protein Ceruloplasmin precursor, are described in Table 30 (given according to their position(s) on the amino acid sequence in the first column; the second column indicates whether the glycosylation site is present in the variant protein; and the last column indicates whether the position is different on the variant protein).

TABLE 30

Glycosylation site(s)

| Position(s) on known amino acid sequence | Present in variant protein? | Position in variant protein? |
|---|---|---|
| 138 | no | |
| 762 | yes | 633 |
| 397 | yes | 268 |
| 358 | yes | 229 |

Variant protein HSCP2_PEA_1_P22 (SEQ ID NO: 853) is encoded by the following transcript(s): HSCP2_PEA_1_T31 (SEQ ID NO: 790), for which the sequence(s) is/are given at the end of the application. The coding portion of transcript HSCP2_PEA_1_T31 (SEQ ID NO: 790) is shown in bold; this coding portion starts at position 250 and ends at position 3057. The transcript also has the following SNPs as listed in Table 31 (given according to their position on the nucleotide sequence, with the alternative nucleic acid listed; the last column indicates whether the SNP is known or not; the presence of known SNPs in variant protein HSCP2_PEA_1_P22 (SEQ ID NO: 853) sequence provides support for the deduced sequence of this variant protein according to the present invention).

TABLE 31

Nucleic acid SNPs

| SNP position on nucleotide sequence | Alternative nucleic acid | Previously known SNP? |
|---|---|---|
| 63 | A -> | No |
| 201 | G -> T | No |
| 326 | T -> | No |
| 335 | T -> | No |
| 358 | T -> C | No |
| 360 | T -> C | No |
| 389 | T -> | No |
| 409 | A -> G | No |
| 437 | T -> | No |
| 524 | T -> C | No |
| 591 | T -> C | No |
| 598 | T -> A | No |
| 666 | A -> G | Yes |
| 686 | T -> C | No |
| 720 | T -> G | No |
| 755 | T -> C | No |
| 775 | A -> G | No |
| 897 | A -> G | No |
| 900 | C -> T | No |
| 966 | G -> A | No |
| 1195 | C -> T | No |
| 1213 | C -> G | No |
| 1230 | G -> A | No |
| 1292 | C -> T | No |
| 1341 | A -> | No |
| 1381 | T -> C | No |
| 1464 | T -> C | No |
| 1466 | T -> C | No |
| 1494 | T -> A | Yes |
| 1551 | A -> G | No |
| 1613 | T -> C | No |
| 1655 | G -> A | Yes |
| 1668 | T -> C | No |
| 1682 | T -> G | Yes |
| 1752 | T -> C | No |
| 1781 | A -> G | No |
| 1812 | A -> C | Yes |
| 1841 | T -> C | No |
| 1887 | A -> | No |
| 1977 | C -> T | No |
| 1994 | A -> | No |
| 2042 | T -> C | No |
| 2105 | A -> | No |
| 2138 | A -> | No |
| 2138 | A -> C | No |
| 2227 | G -> A | No |
| 2641 | G -> A | Yes |
| 2853 | T -> C | No |
| 2889 | A -> G | No |
| 2982 | C -> G | No |
| 3554 | T -> | No |
| 3569 | A -> C | Yes |
| 3829 | G -> A | No |
| 4027 | G -> A | Yes |

Variant protein HSCP2_PEA_1_P24 (SEQ ID NO: 854) according to the present invention has an amino acid sequence as given at the end of the application; it is encoded by transcript(s) HSCP2_PEA_1_T33 (SEQ ID NO: 791). An alignment is given to the known protein (Ceruloplasmin precursor) at the end of the application. One or more alignments to one or more previously published protein sequences are given at the end of the application. A brief description of the relationship of the variant protein according to the present invention to each such aligned protein is as follows:

Comparison report between HSCP2_PEA_1_P24 (SEQ ID NO: 854) and CERU_HUMAN:

1. An isolated chimeric polypeptide encoding for HSCP2_PEA_1_P24 (SEQ ID NO: 854), comprising a first amino acid sequence being at least 70%, optionally at least 80%, preferably at least 85%, more preferably at least 90% and most preferably at least 95% homologous to a polypeptide having the sequence MPLTMGKRNLFLLTP (SEQ ID NO: 1095) corresponding to amino acids 1-15 of HSCP2_PEA_1_P24 (SEQ ID NO: 854), and a second amino acid sequence being at least 90% homologous to VNGYTFGSLPGLSMCAEDRVKWYLFG-MGNEVDVHAAFFHGQALTNKNYRIDTINLFP ATLF-DAYMVAQNPGEWMLSCQNLNHLKA-GLQAFFQVQECNKSSSKDNIRGKHVRHY YIAAEEIIWNYAPSGIDIFTKENL-TAPGSDSAVFFEQGTTRIGGSYKKLVYREYTDASFTN RKERGPEEEHLGILGPVIWAE-VGDTIRVTFHNKGAYPLSIEPIGVR-FNKNNEGTYYSPNY NPQSRSVPPSASHVAPTET-FTYEWTVPKEVGPTNADPVCLAKMYYSAVDPTKDI FTGLI GPMKICKKGSLHANGRQKDVDKEFYLF-PTVFDENESLLLEDNIRMFTTAPDQVDKEDE DFQESNKMHSMNGFMYGNQPGLTMCK-GDSVVWYLFSAGNEADVHGIYFSGNTYLWR GER-RDTANLFPQTSLTLHMWPDTEGTFNVE-CLTTDHYTGGMKQKYTVNQCRRQSEDS TFYLGERTYYIAAVEVEWDYS-PQREWEKELHHLQEQNVSNAFLDKGE-FYIGSKYKKVV YRQYTDSTFRVPVERKAEEE-HLGILGPQLHADVGDKVKIIFKNMATRPYSIHAHGV QTE SSTVTPTLPGETLTYVWKIPERSGAGT-EDSACIPWAYYSTVDQVKDLYSGLIGPLIVCRR PYLKVFNPRRKLEFALLFLVFDENESW-YLDDNIKTYSDHPEKVNKDDEEFIESNKMHAI NGRMFGNLQGLTMHVGDEVNWYLMGMG-NEIDLHTVHFHGHSFQYKHRGVYSSDVF DIFPGTYQ-TLEMFPRTPGIWLLHCHVTDHIHAGMET-TYTVLQNEDTKSG corresponding to amino acids 262-1065 of CERU_HUMAN, which also corresponds to amino acids 16-819 of HSCP2_PEA_1_P24 (SEQ ID NO: 854), wherein said first amino acid sequence and second amino acid sequence are contiguous and in a sequential order.

2. An isolated polypeptide encoding for a head of HSCP2_PEA_1_P24 (SEQ ID NO: 854), comprising a polypeptide being at least 70%, optionally at least about 80%, preferably at least about 85%, more preferably at least about 90% and most preferably at least about 95% homologous to the sequence MPLTMGKRNLFLLTP (SEQ ID NO: 1095) of HSCP2_PEA_1_P24 (SEQ ID NO: 854).

The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Non-secretory protein,NN:YES) predicts that this protein has a signal peptide.

Variant protein HSCP2_PEA_1_P24 (SEQ ID NO: 854) also has the following non-silent SNPs (Single Nucleotide Polymorphisms) as listed in Table 32, (given according to their position(s) on the amino acid sequence, with the alternative amino acid(s) listed; the last column indicates whether the SNP is known or not; the presence of known SNPs in variant protein HSCP2_PEA_1_P24 (SEQ ID NO: 854) sequence provides support for the deduced sequence of this variant protein according to the present invention).

TABLE 32

Amino acid mutations

| SNP position(s) on amino acid sequence | Alternative amino acid(s) | Previously known SNP? |
|---|---|---|
| 3 | L -> P | No |
| 13 | L -> | No |
| 29 | M -> T | No |
| 40 | F -> L | No |
| 52 | F -> S | No |
| 59 | T -> A | No |
| 199 | H -> Y | No |
| 205 | P -> A | No |
| 231 | P -> L | No |
| 247 | P -> | No |
| 261 | S -> P | No |
| 289 | L -> P | No |
| 298 | D -> E | Yes |
| 338 | V -> A | No |
| 352 | R -> K | Yes |
| 361 | V -> G | Yes |
| 394 | D -> G | No |
| 414 | F -> S | No |
| 429 | A -> | No |
| 465 | Q -> | No |
| 481 | F -> S | No |
| 502 | Q -> | No |
| 513 | Q -> P | No |
| 513 | Q -> | No |
| 543 | D -> N | No |
| 681 | E -> K | Yes |
| 794 | C -> W | No |

The glycosylation sites of variant protein HSCP2_PEA_1_P24 (SEQ ID NO: 854), as compared to the known protein Ceruloplasmin precursor, are described in Table 33 (given according to their position(s) on the amino acid sequence in the first column; the second column indicates whether the glycosylation site is present in the variant protein; and the last column indicates whether the position is different on the variant protein).

TABLE 33

Glycosylation site(s)

| Position(s) on known amino acid sequence | Present in variant protein? | Position in variant protein? |
|---|---|---|
| 138 | no | |
| 762 | yes | 516 |
| 397 | yes | 151 |
| 358 | yes | 112 |

Variant protein HSCP2_PEA_1_P24 (SEQ ID NO: 854) is encoded by the following transcript(s): HSCP2_PEA_1_T33 (SEQ ID NO: 791), for which the sequence(s) is/are given at the end of the application. The coding portion of transcript HSCP2_PEA_1_T33 (SEQ ID NO: 791) is shown in bold; this coding portion starts at position 353 and ends at position 2809. The transcript also has the following SNPs as listed in Table 34 (given according to their position on the nucleotide sequence, with the alternative nucleic acid listed; the last column indicates whether the SNP is known or not; the presence of known SNPs in variant protein HSCP2_PEA_1_P24 (SEQ ID NO: 854) sequence provides support for the deduced sequence of this variant protein according to the present invention).

TABLE 34

Nucleic acid SNPs

| SNP position on nucleotide sequence | Alternative nucleic acid | Previously known SNP? |
|---|---|---|
| 63 | A -> | No |
| 201 | G -> T | No |
| 326 | T -> | No |
| 335 | T -> | No |
| 358 | T -> C | No |
| 360 | T -> C | No |
| 389 | T -> | No |
| 418 | A -> G | Yes |
| 438 | T -> C | No |
| 472 | T -> G | No |
| 507 | T -> C | No |
| 527 | A -> G | No |
| 649 | A -> G | No |
| 652 | C -> T | No |
| 718 | G -> A | No |
| 947 | C -> T | No |
| 965 | C -> G | No |
| 982 | G -> A | No |
| 1044 | C -> T | No |
| 1093 | A -> | No |
| 1133 | T -> C | No |
| 1216 | T -> C | No |
| 1218 | T -> C | No |
| 1246 | T -> A | Yes |
| 1303 | A -> G | No |
| 1365 | T -> C | No |
| 1407 | G -> A | Yes |
| 1420 | T -> C | No |
| 1434 | T -> G | Yes |
| 1504 | T -> C | No |
| 1533 | A -> G | No |
| 1564 | A -> C | Yes |
| 1593 | T -> C | No |
| 1639 | A -> | No |
| 1729 | C -> T | No |
| 1746 | A -> | No |
| 1794 | T -> C | No |
| 1857 | A -> | No |
| 1890 | A -> | No |
| 1890 | A -> C | No |
| 1979 | G -> A | No |
| 2393 | G -> A | Yes |
| 2605 | T -> C | No |
| 2641 | A -> G | No |
| 2734 | C -> G | No |
| 3306 | T -> | No |
| 3321 | A -> C | Yes |
| 3581 | G -> A | No |
| 3779 | G -> A | Yes |

Variant protein HSCP2_PEA_1_P25 (SEQ ID NO: 855) according to the present invention has an amino acid sequence as given at the end of the application; it is encoded by transcript(s) HSCP2_PEA_1_T34 (SEQ ID NO: 792). An alignment is given to the known protein (Ceruloplasmin precursor) at the end of the application. One or more alignments to one or more previously published protein sequences are given at the end of the application. A brief description of the relationship of the variant protein according to the present invention to each such aligned protein is as follows:

Comparison report between HSCP2_PEA_1_P25 (SEQ ID NO: 855) and CERU_HUMAN:

1. An isolated chimeric polypeptide encoding for HSCP2_PEA_1_P25 (SEQ ID NO: 855), comprising a first amino acid sequence being at least 90% homologous to MKILILGIFLFLCSTPAWAKEKHYYIGII-ETTWDYASDHGEKKLISVDTEHSNIYLQNGPD RIGR-LYKKALYLQYTDETFRTTIEKPVWLGFLGPIIKAETG DKVYVHLKNLASRPYTFHS HGITYYKEHEGAIYP-DNTTDFQRADDKVYPGEQYTYMLLATE-EQSPGEGDGNCVTRIY HSHIDAPKDIASGLIGPLIICK-KDSLDKEKEKHIDREFVVMFSVVDENFSWYLEDNI KTY CSEPEKVDKDNEDFQESNRMYSVNGYT-FGSLPGLSMCAEDRVKWYLFGMGNEVDVH AAFFH-GQALTNKNYRIDTINLFPATLFDAYMVA-QNPGEWMLSCQNLNHLKAGLQAFF QVQECNKSSSKDNIRGKHVRHYY-IAAEEIIWNYAPSGIDIFTKENLTAPGSDSAVFFEQG TTRIGGSYKKLVYREYTDASFTNRKERG-PEEEHLGILGPVIWAEVGDTIRVTFHNKGAY PLSIEPIGVRFNKNNEGTYYSPNYN-PQSRSVPPSASHVAPTETFTYEWTVPKEVGPTNAD PVCLAKMYYSAVDPTKDIFTGLIGP-MKICKKGSLHANGRQKDVDKEFYLFPTVFDENES LLLEDNIRMFTTAPDQVDKEDEDFQESNKMH corresponding to amino acids 1-621 of CERU_HUMAN, which also corresponds to amino acids 1-621 of HSCP2_PEA_1_P25 (SEQ ID NO: 855), and a second amino acid sequence being at least 70%, optionally at least 80%, preferably at least 85%, more preferably at least 90% and most preferably at least 95% homologous to a polypeptide having the sequence CKYCIIHQSTKLF (SEQ ID NO: 1096) corresponding to amino acids 622-634 of HSCP2_PEA_1_P25 (SEQ ID NO: 855), wherein said first amino acid sequence and second amino acid sequence are contiguous and in a sequential order.

2. An isolated polypeptide encoding for a tail of HSCP2_PEA_1_P25 (SEQ ID NO: 855), comprising a polypeptide being at least 70%, optionally at least about 80%, preferably at least about 85%, more preferably at least about 90% and most preferably at least about 95% homologous to the sequence CKYCIIHQSTKLF (SEQ ID NO: 1096) in HSCP2_PEA_1_P25 (SEQ ID NO: 855).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCP2_PEA_1_P25 (SEQ ID NO: 855) also has the following non-silent SNPs (Single Nucleotide Polymorphisms) as listed in Table 35, (given according to their position(s) on the amino acid sequence, with the alternative amino acid(s) listed; the last column indicates whether the SNP is known or not; the presence of known SNPs in variant protein HSCP2_PEA_1_P25 (SEQ ID NO: 855) sequence provides support for the deduced sequence of this variant protein according to the present invention).

TABLE 35

Amino acid mutations

| SNP position(s) on amino acid sequence | Alternative amino acid(s) | Previously known SNP? |
|---|---|---|
| 26 | I -> | No |
| 29 | I -> | No |
| 37 | S -> P | No |
| 47 | V -> | No |
| 54 | I -> V | No |
| 63 | I -> | No |
| 92 | F -> S | No |
| 117 | Y -> N | No |
| 148 | K -> R | No |
| 173 | N -> | No |
| 186 | P -> | No |
| 190 | A -> G | No |
| 190 | A -> | No |
| 213 | I -> | No |
| 218 | V -> M | No |
| 221 | F -> | No |
| 235 | N -> D | No |
| 253 | F -> L | No |
| 275 | M -> T | No |
| 286 | F -> L | No |
| 298 | F -> S | No |
| 305 | T -> A | No |
| 445 | H -> Y | No |
| 451 | P -> A | No |
| 477 | P -> L | No |
| 493 | P -> | No |
| 507 | S -> P | No |
| 535 | L -> P | No |
| 544 | D -> E | Yes |
| 584 | V -> A | No |
| 598 | R -> K | Yes |
| 607 | V -> G | Yes |

The glycosylation sites of variant protein HSCP2_PEA_1_P25 (SEQ ID NO: 855), as compared to the known protein Ceruloplasmin precursor, are described in Table 36 (given according to their position(s) on the amino acid sequence in the first column; the second column indicates whether the glycosylation site is present in the variant protein; and the last column indicates whether the position is different on the variant protein).

TABLE 36

Glycosylation site(s)

| Position(s) on known amino acid sequence | Present in variant protein? | Position in variant protein? |
|---|---|---|
| 138 | yes | 138 |
| 762 | no | |
| 397 | yes | 397 |
| 358 | yes | 358 |

Variant protein HSCP2_PEA_1_P25 (SEQ ID NO: 855) is encoded by the following transcript(s): HSCP2_PEA_1_T34 (SEQ ID NO: 792), for which the sequence(s) is/are given at the end of the application. The coding portion of transcript HSCP2_PEA_1_T34 (SEQ ID NO: 792) is shown in bold; this coding portion starts at position 250 and ends at position 2151. The transcript also has the following SNPs as listed in Table 37 (given according to their position on the nucleotide sequence, with the alternative nucleic acid listed; the last column indicates whether the SNP is known or not; the presence of known SNPs in variant protein HSCP2_PEA_1_P25 (SEQ ID NO: 855) sequence provides support for the deduced sequence of this variant protein according to the present invention).

TABLE 37

Nucleic acid SNPs

| SNP position on nucleotide sequence | Alternative nucleic acid | Previously known SNP? |
|---|---|---|
| 63 | A -> | No |
| 201 | G -> T | No |
| 326 | T -> | No |
| 335 | T -> | No |
| 358 | T -> C | No |
| 360 | T -> C | No |
| 389 | T -> | No |
| 409 | A -> G | No |
| 437 | T -> | No |
| 524 | T -> C | No |
| 591 | T -> C | No |
| 598 | T -> A | No |
| 692 | A -> G | No |
| 768 | T -> | No |
| 807 | A -> | No |
| 807 | A -> G | No |
| 818 | C -> | No |
| 818 | C -> G | No |
| 837 | T -> C | No |
| 887 | T -> | No |
| 901 | G -> A | No |
| 910 | T -> | No |
| 952 | A -> G | No |
| 1006 | T -> C | No |
| 1053 | A -> G | Yes |
| 1073 | T -> C | No |
| 1107 | T -> G | No |
| 1142 | T -> C | No |
| 1162 | A -> G | No |
| 1284 | A -> G | No |
| 1287 | C -> T | No |
| 1353 | G -> A | No |
| 1582 | C -> T | No |
| 1600 | C -> G | No |
| 1617 | G -> A | No |
| 1679 | C -> T | No |
| 1728 | A -> | No |
| 1768 | T -> C | No |
| 1851 | T -> C | No |
| 1853 | T -> C | No |
| 1881 | T -> A | Yes |
| 1938 | A -> G | No |
| 2000 | T -> C | No |
| 2042 | G -> A | Yes |
| 2055 | T -> C | No |
| 2069 | T -> G | Yes |

Variant protein HSCP2_PEA_1_P33 (SEQ ID NO: 856) according to the present invention has an amino acid sequence as given at the end of the application; it is encoded by transcript(s) HSCP2_PEA_1_T45 (SEQ ID NO: 793). An alignment is given to the known protein (Ceruloplasmin precursor) at the end of the application. One or more alignments to one or more previously published protein sequences are given at the end of the application. A brief description of the relationship of the variant protein according to the present invention to each such aligned protein is as follows:

Comparison report between HSCP2_PEA_1_P33 (SEQ ID NO: 856) and CERU_HUMAN:

1. An isolated chimeric polypeptide encoding for HSCP2_PEA_1_P33 (SEQ ID NO: 856), comprising a first amino acid sequence being at least 90% homologous to MKILILGIFLFLCSTPAWAKEKHYYIGII-ETTWDYASDHGEKKLISVDTEHSNIYLQNGPD RIGR-LYKKALYLQYTDETFRTTIEKPVWLGFLGPIIKAETG DKVYVHLKNLASRPYTFHS HGITYYKEHEGAIYP-DNTTDFQRADDKVYPGEQYTYMLLATE-EQSPGEGDGNCVTRIY HSHIDAPKDIASGLIGPLI-ICKK corresponding to amino acids 1-202 of CERU_HUMAN, which also corresponds to amino acids 1-202 of HSCP2_PEA_1_P33 (SEQ ID NO: 856), and a second amino acid sequence being at least 70%, optionally at least 80%, preferably at least 85%, more preferably at least 90% and most preferably at least 95% homologous to a polypeptide having the sequence GTSSPYCTCYMT-KRQGQGSLSFKKKSSLLC (SEQ ID NO: 1097) corresponding to amino acids 203-232 of HSCP2_PEA_1_P33 (SEQ ID NO: 856), wherein said first amino acid sequence and second amino acid sequence are contiguous and in a sequential order.

2. An isolated polypeptide encoding for a tail of HSCP2_PEA_1_P33 (SEQ ID NO: 856), comprising a polypeptide being at least 70%, optionally at least about 80%, preferably at least about 85%, more preferably at least about 90% and most preferably at least about 95% homologous to the sequence GTSSPYCTCYMTKRQGQGSLSFKKKSS-LLC (SEQ ID NO: 1097) in HSCP2_PEA_1_P33 (SEQ ID NO: 856).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCP2_PEA_1_P33 (SEQ ID NO: 856) also has the following non-silent SNPs (Single Nucleotide Polymorphisms) as listed in Table 38, (given according to their position(s) on the amino acid sequence, with the alternative amino acid(s) listed; the last column indicates whether the SNP is known or not; the presence of known SNPs in variant protein HSCP2_PEA_1_P33 (SEQ ID NO: 856) sequence provides support for the deduced sequence of this variant protein according to the present invention).

TABLE 38

Amino acid mutations

| SNP position(s) on amino acid sequence | Alternative amino acid(s) | Previously known SNP? |
|---|---|---|
| 26 | I -> | No |
| 29 | I -> | No |
| 37 | S -> P | No |
| 47 | V -> | No |
| 54 | I -> V | No |
| 63 | I -> | No |
| 92 | F -> S | No |
| 117 | Y -> N | No |
| 148 | K -> R | No |
| 173 | N -> | No |
| 186 | P -> | No |
| 190 | A -> G | No |
| 190 | A -> | No |

The glycosylation sites of variant protein HSCP2_PEA_1_P33 (SEQ ID NO: 856), as compared to the known protein Ceruloplasmin precursor, are described in Table 39 (given according to their position(s) on the amino acid sequence in the first column; the second column indicates whether the glycosylation site is present in the variant protein; and the last column indicates whether the position is different on the variant protein).

TABLE 39

Glycosylation site(s)

| Position(s) on known amino acid sequence | Present in variant protein? | Position in variant protein? |
|---|---|---|
| 138 | yes | 138 |
| 762 | no | |
| 397 | no | |
| 358 | no | |

Variant protein HSCP2_PEA_1_P33 (SEQ ID NO: 856) is encoded by the following transcript(s): HSCP2_PEA_1_T45 (SEQ ID NO: 793), for which the sequence(s) is/are given at the end of the application. The coding portion of transcript HSCP2_PEA_1_T45 (SEQ ID NO: 793) is shown in bold; this coding portion starts at position 250 and ends at position 945. The transcript also has the following SNPs as listed in Table 40 (given according to their position on the nucleotide sequence, with the alternative nucleic acid listed; the last column indicates whether the SNP is known or not; the presence of known SNPs in variant protein HSCP2_PEA_1_P33 (SEQ ID NO: 856) sequence provides support for the deduced sequence of this variant protein according to the present invention).

TABLE 40

Nucleic acid SNPs

| SNP position on nucleotide sequence | Alternative nucleic acid | Previously known SNP? |
|---|---|---|
| 63 | A -> | No |
| 201 | G -> T | No |
| 326 | T -> | No |
| 335 | T -> | No |
| 358 | T -> C | No |
| 360 | T -> C | No |
| 389 | T -> | No |
| 409 | A -> G | No |
| 437 | T -> | No |
| 524 | T -> C | No |
| 591 | T -> C | No |
| 598 | T -> A | No |
| 692 | A -> G | No |
| 768 | T -> | No |
| 807 | A -> | No |
| 807 | A -> G | No |
| 818 | C -> | No |
| 818 | C -> G | No |
| 837 | T -> C | No |
| 1099 | T -> A | Yes |

As noted above, cluster HSCP2 features 50 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSCP2_PEA_1_node_0 (SEQ ID NO: 795) according to the present invention is supported by 53 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791), HSCP2_PEA_1_T34 (SEQ ID NO: 792), HSCP2_PEA_1_T45 (SEQ ID NO: 793) and HSCP2_PEA_1_T50 (SEQ ID NO: 794). Table 41 below describes the starting and ending position of this segment on each transcript.

TABLE 41

Segment location on transcripts

| Transcript name | Segment starting position | Segment ending position |
|---|---|---|
| HSCP2_PEA_1_T4 (SEQ ID NO:783) | 1 | 395 |
| HSCP2_PEA_1_T13 (SEQ ID NO:784) | 1 | 395 |
| HSCP2_PEA_1_T19 (SEQ ID NO:785) | 1 | 395 |
| HSCP2_PEA_1_T20 (SEQ ID NO:786) | 1 | 395 |
| HSCP2_PEA_1_T22 (SEQ ID NO:787) | 1 | 395 |
| HSCP2_PEA_1_T23 (SEQ ID NO:788) | 1 | 395 |
| HSCP2_PEA_1_T25 (SEQ ID NO:789) | 1 | 395 |
| HSCP2_PEA_1_T31 (SEQ ID NO:790) | 1 | 395 |
| HSCP2_PEA_1_T33 (SEQ ID NO:791) | 1 | 395 |
| HSCP2_PEA_1_T34 (SEQ ID NO:792) | 1 | 395 |
| HSCP2_PEA_1_T45 (SEQ ID NO:793) | 1 | 395 |
| HSCP2_PEA_1_T50 (SEQ ID NO:794) | 1 | 395 |

Segment cluster HSCP2_PEA_1_node_3 (SEQ ID NO: 796) according to the present invention is supported by 53 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T34 (SEQ ID NO: 792), HSCP2_PEA_1_T45 (SEQ ID NO: 793) and HSCP2_PEA_1_T50 (SEQ ID NO: 794). Table 42 below describes the starting and ending position of this segment on each transcript.

TABLE 42

Segment location on transcripts

| Transcript name | Segment starting position | Segment ending position |
|---|---|---|
| HSCP2_PEA_1_T4 (SEQ ID NO:783) | 396 | 587 |
| HSCP2_PEA_1_T13 (SEQ ID NO:784) | 396 | 587 |
| HSCP2_PEA_1_T19 (SEQ ID NO:785) | 396 | 587 |
| HSCP2_PEA_1_T20 (SEQ ID NO:786) | 396 | 587 |
| HSCP2_PEA_1_T22 (SEQ ID NO:787) | 396 | 587 |
| HSCP2_PEA_1_T23 (SEQ ID NO:788) | 396 | 587 |
| HSCP2_PEA_1_T25 (SEQ ID NO:789) | 396 | 587 |

TABLE 42-continued

Segment location on transcripts

| Transcript name | Segment starting position | Segment ending position |
|---|---|---|
| HSCP2_PEA_1_T31 (SEQ ID NO:790) | 396 | 587 |
| HSCP2_PEA_1_T34 (SEQ ID NO:792) | 396 | 587 |
| HSCP2_PEA_1_T45 (SEQ ID NO:793) | 396 | 587 |
| HSCP2_PEA_1_T50 (SEQ ID NO:794) | 396 | 587 |

Segment cluster HSCP2_PEA_1_node_6 (SEQ ID NO: 797) according to the present invention is supported by 63 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T34 (SEQ ID NO: 792), HSCP2_PEA_1_T45 (SEQ ID NO: 793) and HSCP2_PEA_1_T50 (SEQ ID NO: 794). Table 43 below describes the starting and ending position of this segment on each transcript.

TABLE 43

Segment location on transcripts

| Transcript name | Segment starting position | Segment ending position |
|---|---|---|
| HSCP2_PEA_1_T4 (SEQ ID NO:783) | 644 | 830 |
| HSCP2_PEA_1_T13 (SEQ ID NO:784) | 644 | 830 |
| HSCP2_PEA_1_T19 (SEQ ID NO:785) | 644 | 830 |
| HSCP2_PEA_1_T20 (SEQ ID NO:786) | 644 | 830 |
| HSCP2_PEA_1_T22 (SEQ ID NO:787) | 644 | 830 |
| HSCP2_PEA_1_T23 (SEQ ID NO:788) | 644 | 830 |
| HSCP2_PEA_1_T25 (SEQ ID NO:789) | 644 | 830 |
| HSCP2_PEA_1_T34 (SEQ ID NO:792) | 644 | 830 |
| HSCP2_PEA_1_T45 (SEQ ID NO:793) | 644 | 830 |
| HSCP2_PEA_1_T50 (SEQ ID NO:794) | 644 | 830 |

Segment cluster HSCP2_PEA_1_node_8 (SEQ ID NO: 798) according to the present invention is supported by 3 libraries. The number of libraries was determined as previously described. This segment can be found in the following transcript(s): HSCP2_PEA_1_T45 (SEQ ID NO: 793). Table 44 below describes the starting and ending position of this segment on each transcript.

TABLE 44

Segment location on transcripts

| Transcript name | Segment starting position | Segment ending position |
|---|---|---|
| HSCP2_PEA_1_T45 (SEQ ID NO:793) | 857 | 1634 |

Segment cluster HSCP2_PEA_1_node_10 (SEQ ID NO: 799) according to the present invention is supported by 57 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T34 (SEQ ID NO: 792) and HSCP2_PEA_1_T50 (SEQ ID NO: 794). Table 45 below describes the starting and ending position of this segment on each transcript.

TABLE 45

Segment location on transcripts

| Transcript name | Segment starting position | Segment ending position |
|---|---|---|
| HSCP2_PEA_1_T4 (SEQ ID NO:783) | 857 | 1030 |
| HSCP2_PEA_1_T13 (SEQ ID NO:784) | 857 | 1030 |
| HSCP2_PEA_1_T19 (SEQ ID NO:785) | 857 | 1030 |
| HSCP2_PEA_1_T20 (SEQ ID NO:786) | 857 | 1030 |
| HSCP2_PEA_1_T22 (SEQ ID NO:787) | 857 | 1030 |
| HSCP2_PEA_1_T23 (SEQ ID NO:788) | 857 | 1030 |
| HSCP2_PEA_1_T25 (SEQ ID NO:789) | 857 | 1030 |
| HSCP2_PEA_1_134 (SEQ ID NO:792) | 857 | 1030 |
| HSCP2_PEA_1_T50 (SEQ ID NO:794) | 857 | 1030 |

Segment cluster HSCP2_PEA_1_node_14 (SEQ ID NO: 800) according to the present invention is supported by 49 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791), HSCP2_PEA_1_T34 (SEQ ID NO: 792) and HSCP2_PEA_1_T50 (SEQ ID NO: 794). Table 46 below describes the starting and ending position of this segment on each transcript.

TABLE 46

Segment location on transcripts

| Transcript name | Segment starting position | Segment ending position |
|---|---|---|
| HSCP2_PEA_1_T4 (SEQ ID NO:783) | 1089 | 1236 |
| HSCP2_PEA_1_T13 (SEQ ID NO:784) | 1089 | 1236 |
| HSCP2_PEA_1_T19 (SEQ ID NO:785) | 1089 | 1236 |
| HSCP2_PEA_1_T20 (SEQ ID NO:786) | 1089 | 1236 |
| HSCP2_PEA_1_T22 (SEQ ID NO:787) | 1089 | 1236 |
| HSCP2_PEA_1_T23 (SEQ ID NO:788) | 1089 | 1236 |
| HSCP2_PEA_1_T25 (SEQ ID NO:789) | 1089 | 1236 |
| HSCP2_PEA_1_T31 (SEQ ID NO:790) | 702 | 849 |
| HSCP2_PEA_1_T33 (SEQ ID NO:791) | 454 | 601 |
| HSCP2_PEA_1_T34 (SEQ ID NO:792) | 1089 | 1236 |
| HSCP2_PEA_1_T50 (SEQ ID NO:794) | 1089 | 1236 |

Segment cluster HSCP2_PEA_1_node_23 (SEQ ID NO: 801) according to the present invention is supported by 58 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791), HSCP2_PEA_1_T34 (SEQ ID NO: 792) and HSCP2_PEA_1_T50 (SEQ ID NO: 794). Table 47 below describes the starting and ending position of this segment on each transcript.

TABLE 47

Segment location on transcripts

| Transcript name | Segment starting position | Segment ending position |
|---|---|---|
| HSCP2_PEA_1_T4 (SEQ ID NO:783) | 1458 | 1597 |
| HSCP2_PEA_1_T13 (SEQ ID NO:784) | 1458 | 1597 |
| HSCP2_PEA_1_T19 (SEQ ID NO:785) | 1458 | 1597 |
| HSCP2_PEA_1_T20 (SEQ ID NO:786) | 1458 | 1597 |
| HSCP2_PEA_1_T22 (SEQ ID NO:787) | 1458 | 1597 |
| HSCP2_PEA_1_T23 (SEQ ID NO:788) | 1458 | 1597 |
| HSCP2_PEA_1_T25 (SEQ ID NO:789) | 1458 | 1597 |
| HSCP2_PEA_1_T31 (SEQ ID NO:790) | 1071 | 1210 |
| HSCP2_PEA_1_T33 (SEQ ID NO:791) | 823 | 962 |
| HSCP2_PEA_1_T34 (SEQ ID NO:792) | 1458 | 1597 |
| HSCP2_PEA_1_T50 (SEQ ID NO:794) | 1458 | 1597 |

Segment cluster HSCP2_PEA_1_node_26 (SEQ ID NO: 802) according to the present invention is supported by 67 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791), HSCP2_PEA_1_T34 (SEQ ID NO: 792) and HSCP2_PEA_1_T50 (SEQ ID NO: 794). Table 48 below describes the starting and ending position of this segment on each transcript.

TABLE 48

Segment location on transcripts

| Transcript name | Segment starting position | Segment ending position |
|---|---|---|
| HSCP2_PEA_1_T4 (SEQ ID NO:783) | 1598 | 1750 |
| HSCP2_PEA_1_T13 (SEQ ID NO:784) | 1598 | 1750 |
| HSCP2_PEA_1_T19 (SEQ ID NO:785) | 1598 | 1750 |
| HSCP2_PEA_1_T20 (SEQ ID NO:786) | 1598 | 1750 |
| HSCP2_PEA_1_T22 (SEQ ID NO:787) | 1598 | 1750 |
| HSCP2_PEA_1_T23 (SEQ ID NO:788) | 1598 | 1750 |
| HSCP2_PEA_1_T25 (SEQ ID NO:789) | 1598 | 1750 |
| HSCP2_PEA_1_T31 (SEQ ID NO:790) | 1211 | 1363 |
| HSCP2_PEA_1_T33 (SEQ ID NO:791) | 963 | 1115 |
| HSCP2_PEA_1_T34 (SEQ ID NO:792) | 1598 | 1750 |
| HSCP2_PEA_1_T50 (SEQ ID NO:794) | 1598 | 1750 |

Segment cluster HSCP2_PEA_1_node_29 (SEQ ID NO: 803) according to the present invention is supported by 64 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791), HSCP2_PEA_1_T34 (SEQ ID NO: 792) and HSCP2_PEA_1_T50 (SEQ ID NO: 794). Table 49 below describes the starting and ending position of this segment on each transcript.

TABLE 49

Segment location on transcripts

| Transcript name | Segment starting position | Segment ending position |
|---|---|---|
| HSCP2_PEA_1_T4 (SEQ ID NO:783) | 1751 | 1962 |
| HSCP2_PEA_1_T13 (SEQ ID NO:784) | 1751 | 1962 |

TABLE 49-continued

Segment location on transcripts

| Transcript name | Segment starting position | Segment ending position |
|---|---|---|
| HSCP2_PEA_1_T19 (SEQ ID NO:785) | 1751 | 1962 |
| HSCP2_PEA_1_T20 (SEQ ID NO:786) | 1751 | 1962 |
| HSCP2_PEA_1_T22 (SEQ ID NO:787) | 1751 | 1962 |
| HSCP2_PEA_1_T23 (SEQ ID NO:788) | 1751 | 1962 |
| HSCP2_PEA_1_T25 (SEQ ID NO:789) | 1751 | 1962 |
| HSCP2_PEA_1_T31 (SEQ ID NO:790) | 1364 | 1575 |
| HSCP2_PEA_1_T33 (SEQ ID NO:791) | 1116 | 1327 |
| HSCP2_PEA_1_T34 (SEQ ID NO:792) | 1751 | 1962 |
| HSCP2_PEA_1_T50 (SEQ ID NO:794) | 1751 | 1962 |

Segment cluster HSCP2_PEA_1_node_31 (SEQ ID NO: 804) according to the present invention is supported by 72 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791), HSCP2_PEA_1_T34 (SEQ ID NO: 792) and HSCP2_PEA_1_T50 (SEQ ID NO: 794). Table 50 below describes the starting and ending position of this segment on each transcript.

TABLE 50

Segment location on transcripts

| Transcript name | Segment starting position | Segment ending position |
|---|---|---|
| HSCP2_PEA_1_T4 (SEQ ID NO:783) | 1963 | 2113 |
| HSCP2_PEA_1_T13 (SEQ ID NO:784) | 1963 | 2113 |
| HSCP2_PEA_1_T19 (SEQ ID NO:785) | 1963 | 2113 |
| HSCP2_PEA_1_T20 (SEQ ID NO:786) | 1963 | 2113 |
| HSCP2_PEA_1_T22 (SEQ ID NO:787) | 1963 | 2113 |
| HSCP2_PEA_1_T23 (SEQ ID NO:788) | 1963 | 2113 |
| HSCP2_PEA_1_T25 (SEQ ID NO:789) | 1963 | 2113 |
| HSCP2_PEA_1_T31 (SEQ ID NO:790) | 1576 | 1726 |
| HSCP2_PEA_1_T33 (SEQ ID NO:791) | 1328 | 1478 |
| HSCP2_PEA_1_T34 (SEQ ID NO:792) | 1963 | 2113 |
| HSCP2_PEA_1_T50 (SEQ ID NO:794) | 1963 | 2113 |

Segment cluster HSCP2_PEA_1_node_32 (SEQ ID NO: 805) according to the present invention is supported by 5 libraries. The number of libraries was determined as previously described. This segment can be found in the following transcript(s): HSCP2_PEA_1_T34 (SEQ ID NO: 792). Table 51 below describes the starting and ending position of this segment on each transcript.

TABLE 51

Segment location on transcripts

| Transcript name | Segment starting position | Segment ending position |
|---|---|---|
| HSCP2_PEA_1_T34 (SEQ ID NO:792) | 2114 | 2246 |

Segment cluster HSCP2_PEA_1_node_34 (SEQ ID NO: 806) according to the present invention is supported by 65 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 52 below describes the starting and ending position of this segment on each transcript.

TABLE 52

Segment location on transcripts

| Transcript name | Segment starting position | Segment ending position |
|---|---|---|
| HSCP2_PEA_1_T4 (SEQ ID NO:783) | 2114 | 2326 |
| HSCP2_PEA_1_T13 (SEQ ID NO:784) | 2114 | 2326 |
| HSCP2_PEA_1_T20 (SEQ ID NO:786) | 2114 | 2326 |
| HSCP2_PEA_1_T22 (SEQ ID NO:787) | 2114 | 2326 |
| HSCP2_PEA_1_T23 (SEQ ID NO:788) | 2114 | 2326 |
| HSCP2_PEA_1_T25 (SEQ ID NO:789) | 2114 | 2326 |
| HSCP2_PEA_1_T31 (SEQ ID NO:790) | 1727 | 1939 |
| HSCP2_PEA_1_T33 (SEQ ID NO:791) | 1479 | 1691 |
| HSCP2_PEA_1_T50 (SEQ ID NO:794) | 2114 | 2326 |

Segment cluster HSCP2_PEA_1_node_52 (SEQ ID NO: 807) according to the present invention is supported by 8 libraries. The number of libraries was determined as previously described. This segment can be found in the following transcript(s): HSCP2_PEA_1_T22 (SEQ ID NO: 787). Table 53 below describes the starting and ending position of this segment on each transcript.

TABLE 53

Segment location on transcripts

| Transcript name | Segment starting position | Segment ending position |
|---|---|---|
| HSCP2_PEA_1_T22 (SEQ ID NO:787) | 2866 | 4061 |

Segment cluster HSCP2_PEA_1_node_58 (SEQ ID NO: 808) according to the present invention is supported by 89 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 54 below describes the starting and ending position of this segment on each transcript.

TABLE 54

Segment location on transcripts

| Transcript name | Segment starting position | Segment ending position |
| --- | --- | --- |
| HSCP2_PEA_1_T4 (SEQ ID NO:783) | 2911 | 3127 |
| HSCP2_PEA_1_T13 (SEQ ID NO:784) | 2911 | 3127 |
| HSCP2_PEA_1_T19 (SEQ ID NO:785) | 2698 | 2914 |
| HSCP2_PEA_1_T20 (SEQ ID NO:786) | 2911 | 3127 |
| HSCP2_PEA_1_T23 (SEQ ID NO:788) | 2911 | 3127 |
| HSCP2_PEA_1_T25 (SEQ ID NO:789) | 2911 | 3127 |
| HSCP2_PEA_1_T31 (SEQ ID NO:790) | 2524 | 2740 |
| HSCP2_PEA_1_T33 (SEQ ID NO:791) | 2276 | 2492 |
| HSCP2_PEA_1_T50 (SEQ ID NO:794) | 2911 | 3127 |

Segment cluster HSCP2_PEA_1_node_72 (SEQ ID NO: 809) according to the present invention is supported by 2 libraries. The number of libraries was determined as previously described. This segment can be found in the following transcript(s): HSCP2_PEA_1_T4 (SEQ ID NO: 783) and HSCP2_PEA_1_T50 (SEQ ID NO: 794). Table 55 below describes the starting and ending position of this segment on each transcript.

TABLE 55

Segment location on transcripts

| Transcript name | Segment starting position | Segment ending position |
| --- | --- | --- |
| HSCP2_PEA_1_T4 (SEQ ID NO:783) | 3431 | 3636 |
| HSCP2_PEA_1_T50 (SEQ ID NO:794) | 3431 | 3636 |

Segment cluster HSCP2_PEA_1_node_73 (SEQ ID NO: 810) according to the present invention is supported by 28 libraries. The number of libraries was determined as previously described. This segment can be found in the following transcript(s): HSCP2_PEA_1_T4 (SEQ ID NO: 783). Table 56 below describes the starting and ending position of this segment on each transcript.

TABLE 56

Segment location on transcripts

| Transcript name | Segment starting position | Segment ending position |
| --- | --- | --- |
| HSCP2_PEA_1_T4 (SEQ ID NO:783) | 3637 | 5580 |

Segment cluster HSCP2_PEA_1_node_74 (SEQ ID NO: 811) according to the present invention is supported by 86 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T25 (SEQ ID NO: 789), HSCP2_PEA_1_T31 (SEQ ID NO: 790) and HSCP2_PEA_1_T33 (SEQ ID NO: 791). Table 57 below describes the starting and ending position of this segment on each transcript.

TABLE 57

Segment location on transcripts

| Transcript name | Segment starting position | Segment ending position |
| --- | --- | --- |
| HSCP2_PEA_1_T14 (SEQ ID NO:783) | 5581 | 5882 |
| HSCP2_PEA_1_T13 (SEQ ID NO:784) | 3370 | 3671 |
| HSCP2_PEA_1_T19 (SEQ ID NO:785) | 3218 | 3519 |
| HSCP2_PEA_1_T25 (SEQ ID NO:789) | 3426 | 3568 |
| HSCP2_PEA_1_T31 (SEQ ID NO:790) | 3044 | 3345 |
| HSCP2_PEA_1_T33 (SEQ ID NO:791) | 2796 | 3097 |

Segment cluster HSCP2_PEA_1_node_76 (SEQ ID NO: 812) according to the present invention is supported by 69 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T31 (SEQ ID NO: 790) and HSCP2_PEA_1_T33 (SEQ ID NO: 791). Table 58 below describes the starting and ending position of this segment on each transcript.

TABLE 58

Segment location on transcripts

| Transcript name | Segment starting position | Segment ending position |
| --- | --- | --- |
| HSCP2_PEA_1_T4 (SEQ ID NO:783) | 5936 | 6215 |
| HSCP2_PEA_1_T13 (SEQ ID NO:784) | 3725 | 4004 |
| HSCP2_PEA_1_T19 (SEQ ID NO:785) | 3573 | 3852 |
| HSCP2_PEA_1_T31 (SEQ ID NO:790) | 3399 | 3678 |
| HSCP2_PEA_1_T33 (SEQ ID NO:791) | 3151 | 3430 |

Segment cluster HSCP2_PEA_1_node_78 (SEQ ID NO: 813) according to the present invention is supported by 67 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T31 (SEQ ID NO: 790) and HSCP2_PEA_1_T33 (SEQ ID NO: 791). Table 59 below describes the starting and ending position of this segment on each transcript.

TABLE 59

Segment location on transcripts

| Transcript name | Segment starting position | Segment ending position |
|---|---|---|
| HSCP2_PEA_1_T4 (SEQ ID NO:783) | 6270 | 6494 |
| HSCP2_PEA_1_T13 (SEQ ID NO:784) | 4059 | 4283 |
| HSCP2_PEA_1_T19 (SEQ ID NO:785) | 3907 | 4131 |
| HSCP2_PEA_1_T31 (SEQ ID NO:790) | 3733 | 3957 |
| HSCP2_PEA_1_T33 (SEQ ID NO:791) | 3485 | 3709 |

Segment cluster HSCP2_PEA_1_node_80 (SEQ ID NO: 814) according to the present invention is supported by 59 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T31 (SEQ ID NO: 790) and HSCP2_PEA_1_T33 (SEQ ID NO: 791). Table 60 below describes the starting and ending position of this segment on each transcript.

TABLE 60

Segment location on transcripts

| Transcript name | Segment starting position | Segment ending position |
|---|---|---|
| HSCP2_PEA_1_T4 (SEQ ID NO:783) | 6549 | 6807 |
| HSCP2_PEA_1_T13 (SEQ ID NO:784) | 4338 | 4596 |
| HSCP2_PEA_1_T19 (SEQ ID NO:785) | 4186 | 4444 |
| HSCP2_PEA_1_T31 (SEQ ID NO:790) | 4012 | 4270 |
| HSCP2_PEA_1_T33 (SEQ ID NO:791) | 3764 | 4022 |

Segment cluster HSCP2_PEA_1_node_84 (SEQ ID NO. 815) according to the present invention is supported by 55 libraries. The number of libraries was determined as previously described. This segment can be found in the following transcript(s): HSCP2_PEA_1_T20 (SEQ ID NO: 786) and HSCP2_PEA_1_T23 (SEQ ID NO: 788). Table 61 below describes the starting and ending position of this segment on each transcript.

TABLE 61

Segment location on transcripts

| Transcript name | Segment starting position | Segment ending position |
|---|---|---|
| HSCP2_PEA_1_T20 (SEQ ID NO:786) | 3548 | 4013 |
| HSCP2_PEA_1_T23 (SEQ ID NO:788) | 3373 | 3838 |

According to an optional embodiment of the present invention, short segments related to the above cluster are also provided. These segments are up to about 120 bp in length, and so are included in a separate description.

Segment cluster HSCP2_PEA_1_node_4 (SEQ ID NO: 816) according to the present invention is supported by 51 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T34 (SEQ ID NO: 792), HSCP2_PEA_1_T45 (SEQ ID NO: 793) and HSCP2_PEA_1_T50 (SEQ ID NO: 794). Table 62 below describes the starting and ending position of this segment on each transcript.

TABLE 62

Segment location on transcripts

| Transcript name | Segment starting position | Segment ending position |
|---|---|---|
| HSCP2_PEA_1_T4 (SEQ ID NO:783) | 588 | 643 |
| HSCP2_PEA_1_T13 (SEQ ID NO:784) | 588 | 643 |
| HSCP2_PEA_1_T19 (SEQ ID NO:785) | 588 | 643 |
| HSCP2_PEA_1_T20 (SEQ ID NO:786) | 588 | 643 |
| HSCP2_PEA_1_T22 (SEQ ID NO:787) | 588 | 643 |
| HSCP2_PEA_1_T23 (SEQ ID NO:788) | 588 | 643 |
| HSCP2_PEA_1_T25 (SEQ ID NO:789) | 588 | 643 |
| HSCP2_PEA_1_T31 (SEQ ID NO:790) | 588 | 643 |
| HSCP2_PEA_1_T34 (SEQ ID NO:792) | 588 | 643 |
| HSCP2_PEA_1_T45 (SEQ ID NO:793) | 588 | 643 |
| HSCP2_PEA_1_T50 (SEQ ID NO:794) | 588 | 643 |

Segment cluster HSCP2_PEA_1_node_7 (SEQ ID NO: 817) according to the present invention is supported by 56 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T34 (SEQ ID NO: 792), HSCP2_PEA_1_T45 (SEQ ID NO: 793) and HSCP2_PEA_1_T50 (SEQ ID NO: 794). Table 63 below describes the starting and ending position of this segment on each transcript.

TABLE 63

Segment location on transcripts

| Transcript name | Segment starting position | Segment ending position |
|---|---|---|
| HSCP2_PEA_1_T4 (SEQ ID NO:783) | 831 | 856 |
| HSCP2_PEA_1_T13 (SEQ ID NO:784) | 831 | 856 |
| HSCP2_PEA_1_T19 (SEQ ID NO:785) | 831 | 856 |
| HSCP2_PEA_1_T20 (SEQ ID NO:786) | 831 | 856 |
| HSCP2_PEA_1_T22 (SEQ ID NO:787) | 831 | 856 |
| HSCP2_PEA_1_T23 (SEQ ID NO:788) | 831 | 856 |
| HSCP2_PEA_1_T25 (SEQ ID NO:789) | 831 | 856 |
| HSCP2_PEA_1_T34 (SEQ ID NO:792) | 831 | 856 |
| HSCP2_PEA_1_T45 (SEQ ID NO:793) | 831 | 856 |
| HSCP2_PEA_1_T50 (SEQ ID NO:794) | 831 | 856 |

Segment cluster HSCP2_PEA_1_node_13 (SEQ ID NO: 818) according to the present invention is supported by 46 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791), HSCP2_PEA_1_T34 (SEQ ID NO: 792) and HSCP2_PEA_1_T50 (SEQ ID NO: 794). Table 64 below describes the starting and ending position of this segment on each transcript.

TABLE 64

Segment location on transcripts

| Transcript name | Segment starting position | Segment ending position |
|---|---|---|
| HSCP2_PEA_1_T4 (SEQ ID NO:783) | 1031 | 1088 |
| HSCP2_PEA_1_T13 (SEQ ID NO:784) | 1031 | 1088 |
| HSCP2_PEA_1_T19 (SEQ ID NO:785) | 1031 | 1088 |
| HSCP2_PEA_1_T20 (SEQ ID NO:786) | 1031 | 1088 |
| HSCP2_PEA_1_T22 (SEQ ID NO:787) | 1031 | 1088 |
| HSCP2_PEA_1_T23 (SEQ ID NO:788) | 1031 | 1088 |
| HSCP2_PEA_1_T25 (SEQ ID NO:789) | 1031 | 1088 |
| HSCP2_PEA_1_T31 (SEQ ID NO:790) | 644 | 701 |
| HSCP2_PEA_1_T33 (SEQ ID NO:791) | 396 | 453 |
| HSCP2_PEA_1_T34 (SEQ ID NO:792) | 1031 | 1088 |
| HSCP2_PEA_1_T50 (SEQ ID NO:794) | 1031 | 1088 |

Segment cluster HSCP2_PEA_1_node_15 (SEQ ID NO: 819) according to the present invention is supported by 46 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791), HSCP2_PEA_1_T34 (SEQ ID NO: 792) and HSCP2_PEA_1_T50 (SEQ ID NO: 794). Table 65 below describes the starting and ending position of this segment on each transcript.

TABLE 65

Segment location on transcripts

| Transcript name | Segment starting position | Segment ending position |
|---|---|---|
| HSCP2_PEA_1_T4 (SEQ ID NO:783) | 1237 | 1272 |
| HSCP2_PEA_1_T13 (SEQ ID NO:784) | 1237 | 1272 |
| HSCP2_PEA_1_T19 (SEQ ID NO:785) | 1237 | 1272 |
| HSCP2_PEA_1_T20 (SEQ ID NO:786) | 1237 | 1272 |
| HSCP2_PEA_1_T22 (SEQ ID NO:787) | 1237 | 1272 |
| HSCP2_PEA_1_T23 (SEQ ID NO:788) | 1237 | 1272 |
| HSCP2_PEA_1_T25 (SEQ ID NO:789) | 1237 | 1272 |
| HSCP2_PEA_1_T31 (SEQ ID NO:790) | 850 | 885 |
| HSCP2_PEA_1_T33 (SEQ ID NO:791) | 602 | 637 |
| HSCP2_PEA_1_T34 (SEQ ID NO:792) | 1237 | 1272 |
| HSCP2_PEA_1_T50 (SEQ ID NO:794) | 1237 | 1272 |

Segment cluster HSCP2_PEA_1_node_16 (SEQ ID NO: 820) according to the present invention can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791), HSCP2_PEA_1_T34 (SEQ ID NO: 792) and HSCP2_PEA_1_T50 (SEQ ID NO: 794). Table 66 below describes the starting and ending position of this segment on each transcript.

TABLE 66

Segment location on transcripts

| Transcript name | Segment starting position | Segment ending position |
|---|---|---|
| HSCP2_PEA_1_T4 (SEQ ID NO:783) | 1273 | 1285 |
| HSCP2_PEA_1_T13 (SEQ ID NO:784) | 1273 | 1285 |
| HSCP2_PEA_1_T19 (SEQ ID NO:785) | 1273 | 1285 |
| HSCP2_PEA_1_T20 (SEQ ID NO:786) | 1273 | 1285 |
| HSCP2_PEA_1_T22 (SEQ ID NO:787) | 1273 | 1285 |
| HSCP2_PEA_1_T23 (SEQ ID NO:788) | 1273 | 1285 |
| HSCP2_PEA_1_T25 (SEQ ID NO:789) | 1273 | 1285 |
| HSCP2_PEA_1_T31 (SEQ ID NO:790) | 886 | 898 |
| HSCP2_PEA_1_T33 (SEQ ID NO:791) | 638 | 650 |
| HSCP2_PEA_1_T34 (SEQ ID NO:792) | 1273 | 1285 |
| HSCP2_PEA_1_T50 (SEQ ID NO:794) | 1273 | 1285 |

Segment cluster HSCP2_PEA_1_node_18 (SEQ ID NO: 821) according to the present invention can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791), HSCP2_PEA_1_T34 (SEQ ID NO: 792) and HSCP2_PEA_1_T50 (SEQ ID NO: 794). Table 67 below describes the starting and ending position of this segment on each transcript.

TABLE 67

Segment location on transcripts

| Transcript name | Segment starting position | Segment ending position |
|---|---|---|
| HSCP2_PEA_1_T4 (SEQ ID NO:783) | 1286 | 1308 |
| HSCP2_PEA_1_T13 (SEQ ID NO:784) | 1286 | 1308 |
| HSCP2_PEA_1_T19 (SEQ ID NO:785) | 1286 | 1308 |
| HSCP2_PEA_1_T20 (SEQ ID NO:786) | 1286 | 1308 |
| HSCP2_PEA_1_T22 (SEQ ID NO:787) | 1286 | 1308 |
| HSCP2_PEA_1_T23 (SEQ ID NO:788) | 1286 | 1308 |
| HSCP2_PEA_1_T25 (SEQ ID NO:789) | 1286 | 1308 |
| HSCP2_PEA_1_T31 (SEQ ID NO:790) | 899 | 921 |
| HSCP2_PEA_1_T33 (SEQ ID NO:791) | 651 | 673 |
| HSCP2_PEA_1_T34 (SEQ ID NO:792) | 1286 | 1308 |
| HSCP2_PEA_1_T50 (SEQ ID NO:794) | 1286 | 1308 |

Segment cluster HSCP2_PEA_1_node_20 (SEQ ID NO: 822) according to the present invention is supported by 48 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791), HSCP2_PEA_1_T34 (SEQ ID NO: 792) and HSCP2_PEA_1_T50 (SEQ ID NO: 794). Table 68 below describes the starting and ending position of this segment on each transcript.

TABLE 68

Segment location on transcripts

| Transcript name | Segment starting position | Segment ending position |
|---|---|---|
| HSCP2_PEA_1_T4 (SEQ ID NO:783) | 1309 | 1374 |
| HSCP2_PEA_1_T13 (SEQ ID NO:784) | 1309 | 1374 |
| HSCP2_PEA_1_T19 (SEQ ID NO:785) | 1309 | 1374 |
| HSCP2_PEA_1_T20 (SEQ ID NO:786) | 1309 | 1374 |
| HSCP2_PEA_1_T22 (SEQ ID NO:787) | 1309 | 1374 |
| HSCP2_PEA_1_T23 (SEQ ID NO:788) | 1309 | 1374 |
| HSCP2_PEA_1_T25 (SEQ ID NO:789) | 1309 | 1374 |
| HSCP2_PEA_1_T31 (SEQ ID NO:790) | 922 | 987 |
| HSCP2_PEA_1_T33 (SEQ ID NO:791) | 674 | 739 |
| HSCP2_PEA_1_T34 (SEQ ID NO:792) | 1309 | 1374 |
| HSCP2_PEA_1_T50 (SEQ ID NO:794) | 1309 | 1374 |

Segment cluster HSCP2_PEA_1_node_21 (SEQ ID NO: 823) according to the present invention is supported by 49 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791), HSCP2_PEA_1_T34 (SEQ ID NO: 792) and HSCP2_PEA_1_T50 (SEQ ID NO: 794). Table 69 below describes the starting and ending position of this segment on each transcript.

TABLE 69

Segment location on transcripts

| Transcript name | Segment starting position | Segment ending position |
|---|---|---|
| HSCP2_PEA_1_T4 (SEQ ID NO:783) | 1375 | 1457 |
| HSCP2_PEA_1_T13 (SEQ ID NO:784) | 1375 | 1457 |
| HSCP2_PEA_1_T19 (SEQ ID NO:785) | 1375 | 1457 |

TABLE 69-continued

Segment location on transcripts

| Transcript name | Segment starting position | Segment ending position |
|---|---|---|
| HSCP2_PEA_1_T20 (SEQ ID NO:786) | 1375 | 1457 |
| HSCP2_PEA_1_T22 (SEQ ID NO:787) | 1375 | 1457 |
| HSCP2_PEA_1_T23 (SEQ ID NO:788) | 1375 | 1457 |
| HSCP2_PEA_1_T25 (SEQ ID NO:789) | 1375 | 1457 |
| HSCP2_PEA_1_T31 (SEQ ID NO:790) | 988 | 1070 |
| HSCP2_PEA_1_T33 (SEQ ID NO:791) | 740 | 822 |
| HSCP2_PEA_1_T34 (SEQ ID NO:792) | 1375 | 1457 |
| HSCP2_PEA_1_T50 (SEQ ID NO:794) | 1375 | 1457 |

Segment cluster HSCP2_PEA_1_node_37 (SEQ ID NO: 824) according to the present invention is supported by 55 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 70 below describes the starting and ending position of this segment on each transcript.

TABLE 70

Segment location on transcripts

| Transcript name | Segment starting position | Segment ending position |
|---|---|---|
| HSCP2_PEA_1_T4 (SEQ ID NO: 783) | 2327 | 2368 |
| HSCP2_PEA_1_T13 (SEQ ID NO: 784) | 2327 | 2368 |
| HSCP2_PEA_1_T19 (SEQ ID NO: 785) | 2114 | 2155 |
| HSCP2_PEA_1_T20 (SEQ ID NO: 786) | 2327 | 2368 |
| HSCP2_PEA_1_T22 (SEQ ID NO: 787) | 2327 | 2368 |
| HSCP2_PEA_1_T23 (SEQ ID NO: 788) | 2327 | 2368 |
| HSCP2_PEA_1_T25 (SEQ ID NO: 789) | 2327 | 2368 |
| HSCP2_PEA_1_T31 (SEQ ID NO: 790) | 1940 | 1981 |
| HSCP2_PEA_1_T33 (SEQ ID NO: 791) | 1692 | 1733 |
| HSCP2_PEA_1_T50 (SEQ ID NO: 794) | 2327 | 2368 |

Segment cluster HSCP2_PEA_1_node_38 (SEQ ID NO: 825) according to the present invention is supported by 59 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 71 below describes the starting and ending position of this segment on each transcript.

TABLE 71

Segment location on transcripts

| Transcript name | Segment starting position | Segment ending position |
|---|---|---|
| HSCP2_PEA_1_T4 (SEQ ID NO: 783) | 2369 | 2442 |
| HSCP2_PEA_1_T13 (SEQ ID NO: 784) | 2369 | 2442 |
| HSCP2_PEA_1_T19 (SEQ ID NO: 785) | 2156 | 2229 |
| HSCP2_PEA_1_T20 (SEQ ID NO: 786) | 2369 | 2442 |
| HSCP2_PEA_1_T22 (SEQ ID NO: 787) | 2369 | 2442 |
| HSCP2_PEA_1_T23 (SEQ ID NO: 788) | 2369 | 2442 |
| HSCP2_PEA_1_T25 (SEQ ID NO: 789) | 2369 | 2442 |
| HSCP2_PEA_1_T31 (SEQ ID NO: 790) | 1982 | 2055 |
| HSCP2_PEA_1_T33 (SEQ ID NO: 791) | 1734 | 1807 |
| HSCP2_PEA_1_T50 (SEQ ID NO: 794) | 2369 | 2442 |

Segment cluster HSCP2_PEA_1_node_39 (SEQ ID NO: 826) according to the present invention is supported by 57 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 72 below describes the starting and ending position of this segment on each transcript.

TABLE 72

Segment location on transcripts

| Transcript name | Segment starting position | Segment ending position |
|---|---|---|
| HSCP2_PEA_1_T4 (SEQ ID NO: 783) | 2443 | 2505 |
| HSCP2_PEA_1_T13 (SEQ ID NO: 784) | 2443 | 2505 |
| HSCP2_PEA_1_T19 (SEQ ID NO: 785) | 2230 | 2292 |
| HSCP2_PEA_1_T20 (SEQ ID NO: 786) | 2443 | 2505 |
| HSCP2_PEA_1_T22 (SEQ ID NO: 787) | 2443 | 2505 |
| HSCP2_PEA_1_T23 (SEQ ID NO: 788) | 2443 | 2505 |
| HSCP2_PEA_1_T25 (SEQ ID NO: 789) | 2443 | 2505 |
| HSCP2_PEA_1_T31 (SEQ ID NO: 790) | 2056 | 2118 |

TABLE 72-continued

Segment location on transcripts

| Transcript name | Segment starting position | Segment ending position |
|---|---|---|
| HSCP2_PEA_1_T33 (SEQ ID NO: 791) | 1808 | 1870 |
| HSCP2_PEA_1_T50 (SEQ ID NO: 794) | 2443 | 2505 |

Segment cluster HSCP2_PEA_1_node_41 (SEQ ID NO: 827) according to the present invention is supported by 60 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 73 below describes the starting and ending position of this segment on each transcript.

TABLE 73

Segment location on transcripts

| Transcript name | Segment starting position | Segment ending position |
|---|---|---|
| HSCP2_PEA_1_T4 (SEQ ID NO: 783) | 2506 | 2534 |
| HSCP2_PEA_1_T13 (SEQ ID NO: 784) | 2506 | 2534 |
| HSCP2_PEA_1_T19 (SEQ ID NO: 785) | 2293 | 2321 |
| HSCP2_PEA_1_T20 (SEQ ID NO: 786) | 2506 | 2534 |
| HSCP2_PEA_1_T22 (SEQ ID NO: 787) | 2506 | 2534 |
| HSCP2_PEA_1_T23 (SEQ ID NO: 788) | 2506 | 2534 |
| HSCP2_PEA_1_T25 (SEQ ID NO: 789) | 2506 | 2534 |
| HSCP2_PEA_1_T31 (SEQ ID NO: 790) | 2119 | 2147 |
| HSCP2_PEA_1_T33 (SEQ ID NO: 791) | 1871 | 1899 |
| HSCP2_PEA_1_T50 (SEQ ID NO: 794) | 2506 | 2534 |

Segment cluster HSCP2_PEA_1_node_42 (SEQ ID NO: 828) according to the present invention is supported by 18 libraries. The number of libraries was determined as previously described. This segment can be found in the following transcript(s): HSCP2_PEA_1_T22 (SEQ ID NO: 787). Table 74 below describes the starting and ending position of this segment on each transcript.

TABLE 74

Segment location on transcripts

| Transcript name | Segment starting position | Segment ending position |
|---|---|---|
| HSCP2_PEA_1_T22 (SEQ ID NO: 787) | 2535 | 2596 |

Segment cluster HSCP2_PEA_1_node_46 (SEQ ID NO: 829) according to the present invention can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 75 below describes the starting and ending position of this segment on each transcript.

TABLE 75

Segment location on transcripts

| Transcript name | Segment starting position | Segment ending position |
|---|---|---|
| HSCP2_PEA_1_T4 (SEQ ID NO: 783) | 2535 | 2559 |
| HSCP2_PEA_1_T13 (SEQ ID NO: 784) | 2535 | 2559 |
| HSCP2_PEA_1_T19 (SEQ ID NO: 785) | 2322 | 2346 |
| HSCP2_PEA_1_T20 (SEQ ID NO: 786) | 2535 | 2559 |
| HSCP2_PEA_1_T22 (SEQ ID NO: 787) | 2597 | 2621 |
| HSCP2_PEA_1_T23 (SEQ ID NO: 788) | 2535 | 2559 |
| HSCP2_PEA_1_T25 (SEQ ID NO: 789) | 2535 | 2559 |
| HSCP2_PEA_1_T31 (SEQ ID NO: 790) | 2148 | 2172 |
| HSCP2_PEA_1_T33 (SEQ ID NO: 791) | 1900 | 1924 |
| HSCP2_PEA_1_T50 (SEQ ID NO: 794) | 2535 | 2559 |

Segment cluster HSCP2_PEA_1_node_47 (SEQ ID NO: 830) according to the present invention is supported by 59 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 76 below describes the starting and ending position of this segment on each transcript.

TABLE 76

Segment location on transcripts

| Transcript name | Segment starting position | Segment ending position |
|---|---|---|
| HSCP2_PEA_1_T4 (SEQ ID NO: 783) | 2560 | 2674 |
| HSCP2_PEA_1_T13 (SEQ ID NO: 784) | 2560 | 2674 |
| HSCP2_PEA_1_T19 (SEQ ID NO: 785) | 2347 | 2461 |
| HSCP2_PEA_1_T20 (SEQ ID NO: 786) | 2560 | 2674 |
| HSCP2_PEA_1_T22 (SEQ ID NO: 787) | 2622 | 2736 |
| HSCP2_PEA_1_T23 | 2560 | 2674 |

TABLE 76-continued

Segment location on transcripts

| Transcript name | Segment starting position | Segment ending position |
| --- | --- | --- |
| (SEQ ID NO: 788) | | |
| HSCP2_PEA_1_T25 | 2560 | 2674 |
| (SEQ ID NO: 789) | | |
| HSCP2_PEA_1_T31 | 2173 | 2287 |
| (SEQ ID NO: 790) | | |
| HSCP2_PEA_1_T33 | 1925 | 2039 |
| (SEQ ID NO: 791) | | |
| HSCP2_PEA_1_T50 | 2560 | 2674 |
| (SEQ ID NO: 794) | | |

Segment cluster HSCP2_PEA_1_node_50 (SEQ ID NO: 831) according to the present invention is supported by 51 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 77 below describes the starting and ending position of this segment on each transcript.

TABLE 77

Segment location on transcripts

| Transcript name | Segment starting position | Segment ending position |
| --- | --- | --- |
| HSCP2_PEA_1_T4 | 2675 | 2731 |
| (SEQ ID NO: 783) | | |
| HSCP2_PEA_1_T13 | 2675 | 2731 |
| (SEQ ID NO: 784) | | |
| HSCP2_PEA_1_T19 | 2462 | 2518 |
| (SEQ ID NO: 785) | | |
| HSCP2_PEA_1_T20 | 2675 | 2731 |
| (SEQ ID NO: 786) | | |
| HSCP2_PEA_1_T22 | 2737 | 2793 |
| (SEQ ID NO: 787) | | |
| HSCP2_PEA_1_T23 | 2675 | 2731 |
| (SEQ ID NO: 788) | | |
| HSCP2_PEA_1_T25 | 2675 | 2731 |
| (SEQ ID NO: 789) | | |
| HSCP2_PEA_1_T31 | 2288 | 2344 |
| (SEQ ID NO: 790) | | |
| HSCP2_PEA_1_T33 | 2040 | 2096 |
| (SEQ ID NO: 791) | | |
| HSCP2_PEA_1_T50 | 2675 | 2731 |
| (SEQ ID NO: 794) | | |

Segment cluster HSCP2_PEA_1_node_51 (SEQ ID NO: 832) according to the present invention is supported by 58 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T22 (SEQ ID NO: 787), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 78 below describes the starting and ending position of this segment on each transcript.

TABLE 78

Segment location on transcripts

| Transcript name | Segment starting position | Segment ending position |
| --- | --- | --- |
| HSCP2_PEA_1_T4 | 2732 | 2803 |
| (SEQ ID NO: 783) | | |
| HSCP2_PEA_1_T13 | 2732 | 2803 |
| (SEQ ID NO: 784) | | |
| HSCP2_PEA_1_T19 | 2519 | 2590 |
| (SEQ ID NO: 785) | | |
| HSCP2_PEA_1_T20 | 2732 | 2803 |
| (SEQ ID NO: 786) | | |
| HSCP2_PEA_1_T22 | 2794 | 2865 |
| (SEQ ID NO: 787) | | |
| HSCP2_PEA_1_T23 | 2732 | 2803 |
| (SEQ ID NO: 788) | | |
| HSCP2_PEA_1_T25 | 2732 | 2803 |
| (SEQ ID NO: 789) | | |
| HSCP2_PEA_1_T31 | 2345 | 2416 |
| (SEQ ID NO: 790) | | |
| HSCP2_PEA_1_T33 | 2097 | 2168 |
| (SEQ ID NO: 791) | | |
| HSCP2_PEA_1_T50 | 2732 | 2803 |
| (SEQ ID NO: 794) | | |

Segment cluster HSCP2_PEA_1_node_55 (SEQ ID NO: 833) according to the present invention is supported by 65 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 79 below describes the starting and ending position of this segment on each transcript.

TABLE 79

Segment location on transcripts

| Transcript name | Segment starting position | Segment ending position |
| --- | --- | --- |
| HSCP2_PEA_1_T4 | 2804 | 2880 |
| (SEQ ID NO:783) | | |
| HSCP2_PEA_1_T13 | 2804 | 2880 |
| (SEQ ID NO:784) | | |
| HSCP2_PEA_1_T19 | 2591 | 2667 |
| (SEQ ID NO:785) | | |
| HSCP2_PEA_1_T20 | 2804 | 2880 |
| (SEQ ID NO:786) | | |
| HSCP2_PEA_1_T23 | 2804 | 2880 |
| (SEQ ID NO:788) | | |
| HSCP2_PEA_1_T25 | 2804 | 2880 |
| (SEQ ID NO:789) | | |
| HSCP2_PEA_1_T31 | 2417 | 2493 |
| (SEQ ID NO:790) | | |
| HSCP2_PEA_1_T33 | 2169 | 2245 |
| (SEQ ID NO:791) | | |
| HSCP2_PEA_1_T50 | 2804 | 2880 |
| (SEQ ID NO:794) | | |

Segment cluster HSCP2_PEA_1_node_56 (SEQ ID NO: 834) according to the present invention is supported by 58 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 80 below describes the starting and ending position of this segment on each transcript.

TABLE 80

Segment location on transcripts

| Transcript name | Segment starting position | Segment ending position |
|---|---|---|
| HSCP2_PEA_1_T4 (SEQ ID NO: 783) | 2881 | 2910 |
| HSCP2_PEA_1_T13 (SEQ ID NO: 784) | 2881 | 2910 |
| HSCP2_PEA_1_T19 (SEQ ID NO: 785) | 2668 | 2697 |
| HSCP2_PEA_1_T20 (SEQ ID NO: 786) | 2881 | 2910 |
| HSCP2_PEA_1_T23 (SEQ ID NO: 788) | 2881 | 2910 |
| HSCP2_PEA_1_T25 (SEQ ID NO: 789) | 2881 | 2910 |
| HSCP2_PEA_1_T31 (SEQ ID NO: 790) | 2494 | 2523 |
| HSCP2_PEA_1_T33 (SEQ ID NO: 791) | 2246 | 2275 |
| HSCP2_PEA_1_T50 (SEQ ID NO: 794) | 2881 | 2910 |

Segment cluster HSCP2_PEA_1_node_60 (SEQ ID NO: 835) according to the present invention is supported by 90 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 81 below describes the starting and ending position of this segment on each transcript.

TABLE 81

Segment location on transcripts

| Transcript name | Segment starting position | Segment ending position |
|---|---|---|
| HSCP2_PEA_1_T4 (SEQ ID NO: 783) | 3128 | 3234 |
| HSCP2_PEA_1_T13 (SEQ ID NO: 784) | 3128 | 3234 |
| HSCP2_PEA_1_T19 (SEQ ID NO: 785) | 2915 | 3021 |
| HSCP2_PEA_1_T20 (SEQ ID NO: 786) | 3128 | 3234 |
| HSCP2_PEA_1_T23 (SEQ ID NO: 788) | 3128 | 3234 |
| HSCP2_PEA_1_T25 (SEQ ID NO: 789) | 3128 | 3234 |
| HSCP2_PEA_1_T31 (SEQ ID NO: 790) | 2741 | 2847 |
| HSCP2_PEA_1_T33 (SEQ ID NO: 791) | 2493 | 2599 |
| HSCP2_PEA_1_T50 (SEQ ID NO: 794) | 3128 | 3234 |

Segment cluster HSCP2_PEA_1_node_61 (SEQ ID NO: 836) according to the present invention is supported by 81 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T23 (SEQ ID NO: 788), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 82 below describes the starting and ending position of this segment on each transcript.

TABLE 82

Segment location on transcripts

| Transcript name | Segment starting position | Segment ending position |
|---|---|---|
| HSCP2_PEA_1_T4 (SEQ ID NO: 783) | 3235 | 3267 |
| HSCP2_PEA_1_T13 (SEQ ID NO: 784) | 3235 | 3267 |
| HSCP2_PEA_1_T19 (SEQ ID NO: 785) | 3022 | 3054 |
| HSCP2_PEA_1_T20 (SEQ ID NO: 786) | 3235 | 3267 |
| HSCP2_PEA_1_T23 (SEQ ID NO: 788) | 3235 | 3267 |
| HSCP2_PEA_1_T25 (SEQ ID NO: 789) | 3235 | 3267 |
| HSCP2_PEA_1_T31 (SEQ ID NO: 790) | 2848 | 2880 |
| HSCP2_PEA_1_T33 (SEQ ID NO: 791) | 2600 | 2632 |
| HSCP2_PEA_1_T50 (SEQ ID NO: 794) | 3235 | 3267 |

Segment cluster HSCP2_PEA_1_node_67 (SEQ ID NO: 837) according to the present invention can be found in the following transcript(s): HSCP2_PEA_1_T4 (SEQ ID NO: 783), HSCP2_PEA_1_T19 (SEQ ID NO: 785), HSCP2_PEA_1_T20 (SEQ ID NO: 786), HSCP2_PEA_1_T31 (SEQ ID NO: 790), HSCP2_PEA_1_T33 (SEQ ID NO: 791) and HSCP2_PEA_1_T50 (SEQ ID NO: 794). Table 83 below describes the starting and ending position of this segment on each transcript.

TABLE 83

Segment location on transcripts

| Transcript name | Segment starting position | Segment ending position |
|---|---|---|
| HSCP2_PEA_1_T4 (SEQ ID NO: 783) | 3268 | 3272 |
| HSCP2_PEA_1_T19 (SEQ ID NO: 785) | 3055 | 3059 |
| HSCP2_PEA_1_T20 (SEQ ID NO: 786) | 3268 | 3272 |
| HSCP2_PEA_1_T31 (SEQ ID NO: 790) | 2881 | 2885 |
| HSCP2_PEA_1_T33 (SEQ ID NO: 791) | 2633 | 2637 |
| HSCP2_PEA_1_T50 (SEQ ID NO: 794) | 3268 | 3272 |

Segment cluster HSCP2_PEA_1_node_68 (SEQ ID NO: 838) according to the present invention is supported by 88 libraries. The number of libraries was determined as previously described. This segment can be found in the following transcript(s): HSCP2_PEA_1_T4 (SEQ ID NO: 783), HSCP2_PEA_1_T19 (SEQ ID NO: 785), HSCP2_PEA_1_T20 (SEQ ID NO: 786), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 84 below describes the starting and ending position of this segment on each transcript.

TABLE 84

Segment location on transcripts

| Transcript name | Segment starting position | Segment ending position |
|---|---|---|
| HSCP2_PEA_1_T4 (SEQ ID NO: 783) | 3273 | 3328 |
| HSCP2_PEA_1_T19 (SEQ ID NO: 785) | 3060 | 3115 |
| HSCP2_PEA_1_T20 (SEQ ID NO: 786) | 3273 | 3328 |
| HSCP2_PEA_1_T25 (SEQ ID NO: 789) | 3268 | 3323 |
| HSCP2_PEA_1_T31 (SEQ ID NO: 790) | 2886 | 2941 |
| HSCP2_PEA_1_T33 (SEQ ID NO: 791) | 2638 | 2693 |
| HSCP2_PEA_1_T50 (SEQ ID NO: 794) | 3273 | 3328 |

Segment cluster HSCP2_PEA_1_node_69 (SEQ ID NO: 839) according to the present invention is supported by 96 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T20 (SEQ ID NO: 786), HSCP2_PEA_1_T25 (SEQ ID NO: 789), HSCP2_PEA_1_T31 (SEQ ID NO: 790), HSCP2_PEA_1_T33 (SEQ ID NO: 791) and HSCP2_PEA_1_T50 (SEQ ID NO: 794). Table 85 below describes the starting and ending position of this segment on each transcript.

TABLE 85

Segment location on transcripts

| Transcript name | Segment starting position | Segment ending position |
|---|---|---|
| HSCP2_PEA_1_T4 (SEQ ID NO: 783) | 3329 | 3430 |
| HSCP2_PEA_1_T13 (SEQ ID NO: 784) | 3268 | 3369 |
| HSCP2_PEA_1_T19 (SEQ ID NO: 785) | 3116 | 3217 |
| HSCP2_PEA_1_T20 (SEQ ID NO: 786) | 3329 | 3430 |
| HSCP2_PEA_1_T25 (SEQ ID NO: 789) | 3324 | 3425 |
| HSCP2_PEA_1_T31 (SEQ ID NO: 790) | 2942 | 3043 |
| HSCP2_PEA_1_T33 (SEQ ID NO: 791) | 2694 | 2795 |
| HSCP2_PEA_1_T50 (SEQ ID NO: 794) | 3329 | 3430 |

Segment cluster HSCP2_PEA_1_node_70 (SEQ ID NO: 840) according to the present invention can be found in the following transcript(s): HSCP2_PEA_1_T20 (SEQ ID NO: 786). Table 86 below describes the starting and ending position of this segment on each transcript.

TABLE 86

Segment location on transcripts

| Transcript name | Segment starting position | Segment ending position |
|---|---|---|
| HSCP2_PEA_1_T20 (SEQ ID NO: 786) | 3431 | 3442 |

Segment cluster HSCP2_PEA_1_node_75 (SEQ ID NO: 841) according to the present invention is supported by 46 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T31 (SEQ ID NO: 790) and HSCP2_PEA_1_T33 (SEQ ID NO: 791). Table 87 below describes the starting and ending position of this segment on each transcript.

TABLE 87

Segment location on transcripts

| Transcript name | Segment starting position | Segment ending position |
|---|---|---|
| HSCP2_PEA_1_T4 (SEQ ID NO: 783) | 5883 | 5935 |
| HSCP2_PEA_1_T13 (SEQ ID NO: 784) | 3672 | 3724 |
| HSCP2_PEA_1_T19 (SEQ ID NO: 785) | 3520 | 3572 |
| HSCP2_PEA_1_T31 (SEQ ID NO: 790) | 3346 | 3398 |
| HSCP2_PEA_1_T33 (SEQ ID NO: 791) | 3098 | 3150 |

Segment cluster HSCP2_PEA_1_node_77 (SEQ ID NO: 842) according to the present invention is supported by 47 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T31 (SEQ ID NO: 790) and HSCP2_PEA_1_T33 (SEQ ID NO: 791). Table 88 below describes the starting and ending position of this segment on each transcript.

TABLE 88

Segment location on transcripts

| Transcript name | Segment starting position | Segment ending position |
|---|---|---|
| HSCP2_PEA_1_T4 (SEQ ID NO: 783) | 6216 | 6269 |
| HSCP2_PEA_1_T13 (SEQ ID NO: 784) | 4005 | 4058 |
| HSCP2_PEA_1_T19 (SEQ ID NO: 785) | 3853 | 3906 |
| HSCP2_PEA_1_T31 (SEQ ID NO: 790) | 3679 | 3732 |
| HSCP2_PEA_1_T33 (SEQ ID NO: 791) | 3431 | 3484 |

Segment cluster HSCP2_PEA_1_node_79 (SEQ ID NO: 843) according to the present invention is supported by 55 libraries. The number of libraries was determined as previously described. This segment can be found in the following transcript(s): HSCP2_PEA_1_T4 (SEQ ID NO: 783), HSCP2_PEA_1_T13 (SEQ ID NO: 784), HSCP2_PEA_1_T19 (SEQ ID NO: 785), HSCP2_PEA_1_T31 (SEQ ID NO: 790) and HSCP2_PEA_1_T33 (SEQ ID NO: 791). Table 89 below describes the starting and ending position of this segment on each transcript.

TABLE 89

Segment location on transcripts

| Transcript name | Segment starting position | Segment ending position |
|---|---|---|
| HSCP2_PEA_1_T4 (SEQ ID NO: 783) | 6495 | 6548 |
| HSCP2_PEA_1_T13 (SEQ ID NO: 784) | 4284 | 4337 |
| HSCP2_PEA_1_T19 (SEQ ID NO: 785) | 4132 | 4185 |
| HSCP2_PEA_1_T31 (SEQ ID NO: 790) | 3958 | 4011 |
| HSCP2_PEA_1_T33 (SEQ ID NO: 791) | 3710 | 3763 |

Segment cluster HSCP2_PEA_1_node_82 (SEQ ID NO: 844) according to the present invention is supported by 38 libraries. The number of libraries was determined as previously described. This segment can be found in the following transcript(s): HSCP2_PEA_1_T20 (SEQ ID NO: 786) and HSCP2_PEA_1_T23 (SEQ ID NO: 788). Table 90 below describes the starting and ending position of this segment on each transcript.

TABLE 90

Segment location on transcripts

| Transcript name | Segment starting position | Segment ending position |
|---|---|---|
| HSCP2_PEA_1_T20 (SEQ ID NO: 786) | 3443 | 3547 |
| HSCP2_PEA_1_T23 (SEQ ID NO: 788) | 3268 | 3372 |

Variant protein alignment to the previously known protein:

Sequence name: CERU_HUMAN

Sequence documentation:

Alignment of: HSCP2_PEA_1_P4 (SEQ ID NO: 846) x CERU_HUMAN . . .

Alignment segment 1/1:
   Quality: 10630.00

Escore: 0
   Matching length: 1060 Total length: 1060

Matching Percent Similarity: 100.00 Matching Percent Identity: 100.00
   Total Percent Similarity: 100.00 Total Percent Identity: 100.00
   Gaps: 0

Alignment:

```
  1 MKILILGIFLFLCSTPAWAKEKHYYIGIIETTWDYASDHGEKKLISVDTE  50
    |||||||||||||||||||||||||||||||||||||||||||||||||
  1 MKILILGIFLFLCSTPAWAKEKHYYIGIIETTWDYASDHGEKKLISVDTE  50

51 HSNIYLQNGPDRIGRLYKKALYLQYTDETFRTTIEKPVWLGFLGPIIKAE 100
    |||||||||||||||||||||||||||||||||||||||||||||||||
 51 HSNIYLQNGPDRIGRLYKKALYLQYTDETFRTTIEKPVWLGFLGPIIKAE 100

101 TGDKVYVHLKNLASRPYTFHSHGITYYKEHEGAIYPDNTTDFQRADDKVY 150
    |||||||||||||||||||||||||||||||||||||||||||||||||
101 TGDKVYVHLKNLASRPYTFHSHGITYYKEHEGAIYPDNTTDFQRADDKVY 150

151 PGEQYTYMLLATEEQSPGEGDGNCVTRIYHSIDAPKDIASGLIGPLIIC  200
    |||||||||||||||||||||||||||||||||||||||||||||||||
151 PGEQYTYMLLATEEQSPGEGDGNCVTRIYHSIDAPKDIASGLIGPLIIC  200

201 KKDSLDKEKEKHIDREFVVMFSVVDENFSWYLEDNIKTYCSEPEKVDKDN 250
    |||||||||||||||||||||||||||||||||||||||||||||||||
201 KKDSLDKEKEKHIDREFVVMFSVVDENFSWYLEDNIKTYCSEPEKVDKDN 250

251 EDFQESNRMYSVNGYTFGSLPGLSMCAEDRVKWYLFGMGNEVDVHAAFFH 300
    |||||||||||||||||||||||||||||||||||||||||||||||||
251 EDFQESNRMYSVNGYTFGSLPGLSMCAEDRVKWYLFGMGNEVDVHAAFFH 300

301 GQALTNKNYRIDTINLFPATLFDAYMVAQNPGEWMLSCQNLNHLKAGLQA 350
    |||||||||||||||||||||||||||||||||||||||||||||||||
301 GQALTNKNYRIDTINLFPATLFDAYMVAQNPGEWMLSCQNLNHLKAGLQA 350

351 FFQVQECNKSSSKDNIRGKHVRHYYIAAEEIIWNYAOSGIDIFTKENLTA 400
    |||||||||||||||||||||||||||||||||||||||||||||||||
351 FFQVQECNKSSSKDNIRGKHVRHYYIAAEEIIWNYAOSGIDIFTKENLTA 400

401 PGSDSAVFFEQGTTRIGGSYKKLVYREYTDASFTNRKERGPEEEHLGILG 450
    |||||||||||||||||||||||||||||||||||||||||||||||||
401 PGSDSAVFFEQGTTRIGGSYKKLVYREYTDASFTNRKERGPEEEHLGILG 450

451 PVIWAEVGDTIRVTFHNKGAYPLSIEPIGVRFNKNNEGTYYSPNYNPQSR 500
    |||||||||||||||||||||||||||||||||||||||||||||||||
451 PVIWAEVGDTIRVTFHNKGAYPLSIEPIGVRFNKNNEGTYYSPNYNPQSR 500
```

-continued

```
501  SVPPHASHVAPTETFTYEWTVPKEVGPTNADPVCLAKMYYSAVDPTKDIF  550
     ||||||||||||||||||||||||||||||||||||||||||||||||||
501  SVPPHASHVAPTETFTYEWTVPKEVGPTNADPVCLAKMYYSAVDPTKDIF  550

551  TGLIGPMKICKKGSLHANGRQKDVDKEFYLFPTVFDENESLLLEDNIRMF  600
     ||||||||||||||||||||||||||||||||||||||||||||||||||
551  TGLIGPMKICKKGSLHANGRQKDVDKEFYLFPTVFDENESLLLEDNIRMF  600

601  TTAPDQVDKEDEDFQESNKMHSMNGFMYGNQPGLTMCKGDSVVWYLFSAG  650
     ||||||||||||||||||||||||||||||||||||||||||||||||||
601  TTAPDQVDKEDEDFQESNKMHSMNGFMYGNQPGLTMCKGDSVVWYLFSAG  650

651  NEADVHGIYFSGNTYLWRGERRDTANLFPQTSLTLHMWPDTEGTFNVECL  700
     ||||||||||||||||||||||||||||||||||||||||||||||||||
651  NEADVHGIYFSGNTYLWRGERRDTANLFPQTSLTLHMWPDTEGTFNVECL  700

701  TTDHYTGGMKQKYTVNQCRRQSEDSTFYLGERTYYIAAVEVEWDYSPQRE  750
     ||||||||||||||||||||||||||||||||||||||||||||||||||
701  TTDHYTGGMKQKYTVNQCRRQSEDSTFYLGERTYYIAAVEVEWDYSPQRE  750

751  WEKELHHLQEQNVSNAFLDKGEFYIGSKYKKVVYRQYTDSTFRVPVERKA  800
     ||||||||||||||||||||||||||||||||||||||||||||||||||
751  WEKELHHLQEQNVSNAFLDKGEFYIGSKYKKVVYRQYTDSTFRVPVERKA  800

801  EEEHLGILGPQLHADVGDKVKIIFKNMATRPYSIHAHGVQTESSTCTPTL  850
     ||||||||||||||||||||||||||||||||||||||||||||||||||
801  EEEHLGILGPQLHADVGDKVKIIFKNMATRPYSIHAHGVQTESSTCTPTL  850

851  PGETLTYVWKIPERSGAGTEDSACIPWAYYSTVDQVKDLYSGLIGPLIVC  900
     ||||||||||||||||||||||||||||||||||||||||||||||||||
851  PGETLTYVWKIPERSGAGTEDSACIPWAYYSTVDQVKDLYSGLIGPLIVC  900

901  RRPYLKVFNPRRKLEFALLFLVFDENESWYLDDNIKTYSDHPEKVNKDDE  950
     ||||||||||||||||||||||||||||||||||||||||||||||||||
901  RRPYLKVFNPRRKLEFALLFLVFDENESWYLDDNIKTYSDHPEKVNKDDE  950

951  EFIESNKMHAINGRMFGNLQGLTMHVGDEVNWYLMGMGNEIDLHTVHFHG  1000
     ||||||||||||||||||||||||||||||||||||||||||||||||||
951  EFIESNKMHAINGRMFGNLQGLTMHVGDEVNWYLMGMGNEIDLHTVHFHG  1000

1001 HSFQYKHRGVYSSDVFDIFPGTYQTLEMFPRTPGIWLLHCHVTDHIHAGM  1050
     ||||||||||||||||||||||||||||||||||||||||||||||||||
1001 HSFQYKHRGVYSSDVFDIFPGTYQTLEMFPRTPGIWLLHCHVTDHIHAGM  1050

1051 ETTYTVLQNE                                          1060
     ||||||||||
1051 ETTYTVLQNE                                          1060
```

Sequence name: CERU_HUMAN

Sequence documentation:

Alignment of: HSCP2_PEA_1_P8 (SEQ ID NO: 847) x CERU_HUMAN . . .

Alignment segment 1/1:
  Quality: 10079.00
  Escore: 0
  Matching length: 1006 Total length: 1006

Matching Percent Similarity: 100.00 Matching Percent Identity: 100.00

Total Percent Similarity: 100.00 Total Percent Identity: 100.00

Gaps: 0

Alignment:

```
  1  MKILILGIFLFLCSTPAWAKEKHYYIGIIETTWDYASDHGEKKLISVDTE   50
     ||||||||||||||||||||||||||||||||||||||||||||||||||
  1  MKILILGIFLFLCSTPAWAKEKHYYIGIIETTWDYASDHGEKKLISVDTE   50

51  HSNIYLQNGPDRIGRLYKKALYLQYTDETFRTTIEKPVWLGFLGPIIKAE  100
     ||||||||||||||||||||||||||||||||||||||||||||||||||
 51  HSNIYLQNGPDRIGRLYKKALYLQYTDETFRTTIEKPVWLGFLGPIIKAE  100

101  TGDKVYVHLKNLASRPYTFHSHGITYYKEHEGAIYPDNTTDFQRADDKVY  150
     ||||||||||||||||||||||||||||||||||||||||||||||||||
101  TGDKVYVHLKNLASRPYTFHSHGITYYKEHEGAIYPDNTTDFQRADDKVY  150
```

```
151  PGEQYTYMLLATEEQSPGEGDGNCVTRIYHSHIDAPKDIASGLIGPLIIC  200
     ||||||||||||||||||||||||||||||||||||||||||||||||||
151  PGEQYTYMLLATEEQSPGEGDGNCVTRIYHSHIDAPKDIASGLIGPLIIC  200

201  KKDSLDKEKEKHIDREFVVMFSVVDENFSWYLEDNIKTYCSEPEKVDKDN  250
     ||||||||||||||||||||||||||||||||||||||||||||||||||
201  KKDSLDKEKEKHIDREFVVMFSVVDENFSWYLEDNIKTYCSEPEKVDKDN  250

251  EDFQESNRMYSVNGYTFGSLPGLSMCAEDRVKWYLFGMGNEVDVHAAFFH  300
     ||||||||||||||||||||||||||||||||||||||||||||||||||
251  EDFQESNRMYSVNGYTFGSLPGLSMCAEDRVKWYLFGMGNEVDVHAAFFH  300

301  GQALTNKNYRIDTINLFPATLFDAYMVAQNPGEWMLSCQNLNHLKAGLQA  350
     ||||||||||||||||||||||||||||||||||||||||||||||||||
301  GQALTNKNYRIDTINLFPATLFDAYMVAQNPGEWMLSCQNLNHLKAGLQA  350

351  FFQVQECNKSSSKDNIRGKHVRHYYIAAEEIIWNYAOSGIDIFTKENLTA  400
     ||||||||||||||||||||||||||||||||||||||||||||||||||
351  FFQVQECNKSSSKDNIRGKHVRHYYIAAEEIIWNYAOSGIDIFTKENLTA  400

401  PGSDSAVFFEQGTTRIGGSYKKLVYREYTDASFTNRKERGPEEEHLGILG  450
     ||||||||||||||||||||||||||||||||||||||||||||||||||
401  PGSDSAVFFEQGTTRIGGSYKKLVYREYTDASFTNRKERGPEEEHLGILG  450

451  PVIWAEVGDTIRVTFHNKGAYPLSIEPIGVRFNKNNEGTYYSPNYNPQSR  500
     ||||||||||||||||||||||||||||||||||||||||||||||||||
451  PVIWAEVGDTIRVTFHNKGAYPLSIEPIGVRFNKNNEGTYYSPNYNPQSR  500

501  SVPPHASHVAPTETFTYEWTVPKEVGPTNADPVCLAKMYYSAVDPTKDIF  550
     ||||||||||||||||||||||||||||||||||||||||||||||||||
501  SVPPHASHVAPTETFTYEWTVPKEVGPTNADPVCLAKMYYSAVDPTKDIF  550

551  TGLIGPMKICKKGSLHANGRQKDVDKEFYLFPTVFDENESLLLEDNIRMF  600
     ||||||||||||||||||||||||||||||||||||||||||||||||||
551  TGLIGPMKICKKGSLHANGRQKDVDKEFYLFPTVFDENESLLLEDNIRMF  600

601  TTAPDQVDKEDEDFQESNKMHSMNGFMYGNQPGLTMCKGDSVVWYLFSAG  650
     ||||||||||||||||||||||||||||||||||||||||||||||||||
601  TTAPDQVDKEDEDFQESNKMHSMNGFMYGNQPGLTMCKGDSVVWYLFSAG  650

651  NEADVHGIYFSGNTYLWRGERRDTANLFPQTSLTLHMWPDTEGTFNVECL  700
     ||||||||||||||||||||||||||||||||||||||||||||||||||
651  NEADVHGIYFSGNTYLWRGERRDTANLFPQTSLTLHMWPDTEGTFNVECL  700

701  TTDHYTGGMKQKYTVNQCRRQSEDSTFYLGERTYYIAAVEVEWDYSPQRE  750
     ||||||||||||||||||||||||||||||||||||||||||||||||||
701  TTDHYTGGMKQKYTVNQCRRQSEDSTFYLGERTYYIAAVEVEWDYSPQRE  750

751  WEKELHHLQEQNVSNAFLDKGEFYIGSKYKKVVYRQYTDSTFRVPVERKA  800
     ||||||||||||||||||||||||||||||||||||||||||||||||||
751  WEKELHHLQEQNVSNAFLDKGEFYIGSKYKKVVYRQYTDSTFRVPVERKA  800

801  EEEHLGILGPQLHADVGDKVKIIFKNMATRPYSIHAHGVQTESSTCTPTL  850
     ||||||||||||||||||||||||||||||||||||||||||||||||||
801  EEEHLGILGPQLHADVGDKVKIIFKNMATRPYSIHAHGVQTESSTCTPTL  850

851  PGETLTYVWKIPERSGAGTEDSACIPWAYYSTVDQVKDLYSGLIGPLIVC  900
     ||||||||||||||||||||||||||||||||||||||||||||||||||
851  PGETLTYVWKIPERSGAGTEDSACIPWAYYSTVDQVKDLYSGLIGPLIVC  900

901  RRPYLKVFNPRRKLEFALLFLVFDENESWYLDDNIKTYSDHPEKVNKDDE  950
     ||||||||||||||||||||||||||||||||||||||||||||||||||
901  RRPYLKVFNPRRKLEFALLFLVFDENESWYLDDNIKTYSDHPEKVNKDDE  950

951  EFIESNKMHAINGRMFGNLQGLTMHVGDEVNWYLMGMGNEIDLHTVHFHG  1000
     ||||||||||||||||||||||||||||||||||||||||||||||||||
951  EFIESNKMHAINGRMFGNLQGLTMHVGDEVNWYLMGMGNEIDLHTVHFHG  1000

1001 HSFQYK  1006
     ||||||
1001 HSFQYK  1006
```

Sequence name: CERU_HUMAN
length: 1065

Sequence documentation:

Alignment of: HSCP2_PEA_1_P14 (SEQ ID NO: 848) x CERU_HUMAN ...

Matching Percent Similarity: 99.90 Matching Percent Identity: 99.90

Total Percent Similarity: 93.24 Total Percent Identity: 93.24

Alignment segment 1/1:
Quality: 9832.00

Gaps: 1

Escore: 0

Matching length: 994 Total

Alignment:

```
  1  MKILILGIFLFLCSTPAWAKEKHYYIGIIETTWDYASDHGEKKLISVDTE   50
     ||||||||||||||||||||||||||||||||||||||||||||||||||
  1  MKILILGIFLFLCSTPAWAKEKHYYIGIIETTWDYASDHGEKKLISVDTE   50

51  HSNIYLQNGPDRIGRLYKKALYLQYTDETFRTTIEKPVWLGFLGPIIKAE  100
     ||||||||||||||||||||||||||||||||||||||||||||||||||
 51  HSNIYLQNGPDRIGRLYKKALYLQYTDETFRTTIEKPVWLGFLGPIIKAE  100

101  TGDKVYVHLKNLASRPYTFHSHGITYYKEHEGAIYPDNTTDFQRADDKVY  150
     ||||||||||||||||||||||||||||||||||||||||||||||||||
101  TGDKVYVHLKNLASRPYTFHSHGITYYKEHEGAIYPDNTTDFQRADDKVY  150

151  PGEQYTYMLLATEEQSPGEGDGNCVTRIYHSHIDAPKDIASGLIGPLIIC  200
     ||||||||||||||||||||||||||||||||||||||||||||||||||
151  PGEQYTYMLLATEEQSPGEGDGNCVTRIYHSHIDAPKDIASGLIGPLIIC  200

201  KKDSLDKEKEKHIDREFVVMFSVVDENFSWYLEDNIKTYCSEPEKVDKDN  250
     ||||||||||||||||||||||||||||||||||||||||||||||||||
201  KKDSLDKEKEKHIDREFVVMFSVVDENFSWYLEDNIKTYCSEPEKVDKDN  250

251  EDFQESNRMYSVNGYTFGSLPGLSMCAEDRVKWYLFGMGNEVDVHAAFFH  300
     ||||||||||||||||||||||||||||||||||||||||||||||||||
251  EDFQESNRMYSVNGYTFGSLPGLSMCAEDRVKWYLFGMGNEVDVHAAFFH  300

301  GQALTNKNYRIDTINLFPATLFDAYMVAQNPGEWMLSCQNLNHLKAGLQA  350
     ||||||||||||||||||||||||||||||||||||||||||||||||||
301  GQALTNKNYRIDTINLFPATLFDAYMVAQNPGEWMLSCQNLNHLKAGLQA  350

351  FFQVQECNKSSSKDNIRGKHVRHYYIAAEEIIWNYAOSGIDIFTKENLTA  400
     ||||||||||||||||||||||||||||||||||||||||||||||||||
351  FFQVQECNKSSSKDNIRGKHVRHYYIAAEEIIWNYAOSGIDIFTKENLTA  400

401  PGSDSAVFFEQGTTRIGGSYKKLVYREYTDASFTNRKERGPEEEHLGILG  450
     ||||||||||||||||||||||||||||||||||||||||||||||||||
401  PGSDSAVFFEQGTTRIGGSYKKLVYREYTDASFTNRKERGPEEEHLGILG  450

451  PVIWAEVGDTIRVTFHNKGAYPLSIEPIGVRFNKNNEGTYYSPNYNPQSR  500
     ||||||||||||||||||||||||||||||||||||||||||||||||||
451  PVIWAEVGDTIRVTFHNKGAYPLSIEPIGVRFNKNNEGTYYSPNYNPQSR  500

501  SVPPHASHVAPTETFTYEWTVPKEVGPTNADPVCLAKMYYSAVDPTKDIF  550
     ||||||||||||||||||||||||||||||||||||||||||||||||||
501  SVPPHASHVAPTETFTYEWTVPKEVGPTNADPVCLAKMYYSAVDPTKDIF  550

551  TGLIGPMKICKKGSLHANGRQKDVDKEFYLFPTVFDENESLLLEDNIRMF  600
     ||||||||||||||||||||||||||||||||||||||||||||||||||
551  TGLIGPMKICKKGSLHANGRQKDVDKEFYLFPTVFDENESLLLEDNIRMF  600

601  TTAPDQVDKEDEDFQESNKMH............................  621
     |||||||||||||||||||||
601  TTAPDQVDKEDEDFQESNKMHSMNGFMYGNQPGLTMCKGDSVVWYLFSAG  650

622  ........................................WTFNVECL  629
                                             ||||||||
651  NEADVHGIYFSGNTYLWRGERRDTANLFPQTSLTLHMWPDTEGTFNVECL  700

630  TTDHYTGGMKQKYTVNQCRRQSEDSTFYLGERTYYIAAVEVEWDYSPQRE  679
     ||||||||||||||||||||||||||||||||||||||||||||||||||
701  TTDHYTGGMKQKYTVNQCRRQSEDSTFYLGERTYYIAAVEVEWDYSPQRE  750

680  WEKELHHLQEQNVSNAFLDKGEFYIGSKYKKVVYRQYTDSTFRVPVERKA  729
     ||||||||||||||||||||||||||||||||||||||||||||||||||
751  WEKELHHLQEQNVSNAFLDKGEFYIGSKYKKVVYRQYTDSTFRVPVERKA  800

730  EEEHLGILGPQLHADVGDKVKIIFKNMATRPYSIHAHGVQTESSTCTPTL  779
     ||||||||||||||||||||||||||||||||||||||||||||||||||
801  EEEHLGILGPQLHADVGDKVKIIFKNMATRPYSIHAHGVQTESSTCTPTL  850
```

-continued

```
 780 PGETLTYVWKIPERSGAGTEDSACIPWAYYSTVDQVKDLYSGLIGPLIVC  829
     ||||||||||||||||||||||||||||||||||||||||||||||||||
 851 PGETLTYVWKIPERSGAGTEDSACIPWAYYSTVDQVKDLYSGLIGPLIVC  900

830 RRPYLKVFNPRRKLEFALLFLVFDENESWYLDDNIKTYSDHPEKVNKDDE  879
     |||||||||||||||||||||||||||||||||||||||||||||||||
 901 RRPYLKVFNPRRKLEFALLFLVFDENESWYLDDNIKTYSDHPEKVNKDDE  950

880 EFIESNKMHAINGRMFGNLQGLTMHVGDEVNWYLMGMGNEIDLHTVHFHG  929
     |||||||||||||||||||||||||||||||||||||||||||||||||
 951 EFIESNKMHAINGRMFGNLQGLTMHVGDEVNWYLMGMGNEIDLHTVHFHG  1000

930 HSFQYKHRGVYSSDVFDIFPGTYQTLEMFPRTPGIWLLHCHVTDHIHAGM  979
     |||||||||||||||||||||||||||||||||||||||||||||||||
1001 HSFQYKHRGVYSSDVFDIFPGTYQTLEMFPRTPGIWLLHCHVTDHIHAGM  1050

980 ETTYTVLQNEDTKSG                                     994
     |||||||||||||||
1051 ETTYTVLQNEDTKSG                                    1065
```

Sequence name: CERU_HUMAN

Sequence documentation:

Alignment of: HSCP2_PEA_1_P15 (SEQ ID NO: 849) x CERU_HUMAN . . .

Alignment segment 1/1:
  Quality: 10630.00

Escore: 0
  Matching length: 1060 Total length: 1060

Matching Percent Similarity: 100.00 Matching Percent Identity: 100.00

Total Percent Similarity: 100.00 Total Percent Identity: 100.00

Gaps: 0

Alignment:

```
   1 MKILILGIFLFLCSTPAWAKEKHYYIGIIETTWDYASDHGEKKLISVDTE   50
     ||||||||||||||||||||||||||||||||||||||||||||||||||
   1 MKILILGIFLFLCSTPAWAKEKHYYIGIIETTWDYASDHGEKKLISVDTE   50

51 HSNIYLQNGPDRIGRLYKKALYLQYTDETFRTTIEKPVWLGFLGPIIKAE  100
     |||||||||||||||||||||||||||||||||||||||||||||||||
  51 HSNIYLQNGPDRIGRLYKKALYLQYTDETFRTTIEKPVWLGFLGPIIKAE  100

101 TGDKVYVHLKNLASRPYTFHSHGITYYKEHEGAIYPDNTTDFQRADDKVY  150
     |||||||||||||||||||||||||||||||||||||||||||||||||
 101 TGDKVYVHLKNLASRPYTFHSHGITYYKEHEGAIYPDNTTDFQRADDKVY  150

151 PGEQYTYMLLATEEQSPGEGDGNCVTRIYHSHIDAPKDIASGLIGPLIIC  200
     |||||||||||||||||||||||||||||||||||||||||||||||||
 151 PGEQYTYMLLATEEQSPGEGDGNCVTRIYHSHIDAPKDIASGLIGPLIIC  200

201 KKDSLDKEKEKHIDREFVVMFSVVDENFSWYLEDNIKTYCSEPEKVDKDN  250
     |||||||||||||||||||||||||||||||||||||||||||||||||
 201 KKDSLDKEKEKHIDREFVVMFSVVDENFSWYLEDNIKTYCSEPEKVDKDN  250

251 EDFQESNRMYSVNGYTFGSLPGLSMCAEDRVKWYLFGMGNEVDVHAAFFH  300
     |||||||||||||||||||||||||||||||||||||||||||||||||
 251 EDFQESNRMYSVNGYTFGSLPGLSMCAEDRVKWYLFGMGNEVDVHAAFFH  300

301 GQALTNKNYRIDTINLFPATLFDAYMVAQNPGEWMLSCQNLNHLKAGLQA  350
     |||||||||||||||||||||||||||||||||||||||||||||||||
 301 GQALTNKNYRIDTINLFPATLFDAYMVAQNPGEWMLSCQNLNHLKAGLQA  350

351 FFQVQECNKSSSKDNIRGKHVRHYYIAAEEIIWNYAOSGIDIFTKENLTA  400
     |||||||||||||||||||||||||||||||||||||||||||||||||
 351 FFQVQECNKSSSKDNIRGKHVRHYYIAAEEIIWNYAOSGIDIFTKENLTA  400

401 PGSDSAVFFEQGTTRIGGSYKKLVYREYTDASFTNRKERGPEEEHLGILG  450
     |||||||||||||||||||||||||||||||||||||||||||||||||
 401 PGSDSAVFFEQGTTRIGGSYKKLVYREYTDASFTNRKERGPEEEHLGILG  450

451 PVIWAEVGDTIRVTFHNKGAYPLSIEPIGVRFNKNNEGTYYSPNYNPQSR  500
     |||||||||||||||||||||||||||||||||||||||||||||||||
 451 PVIWAEVGDTIRVTFHNKGAYPLSIEPIGVRFNKNNEGTYYSPNYNPQSR  500
```

-continued

```
501  SVPPHASHVAPTETFTYEWTVPKEVGPTNADPVCLAKMYYSAVDPTKDIF  550
     ||||||||||||||||||||||||||||||||||||||||||||||||||
501  SVPPHASHVAPTETFTYEWTVPKEVGPTNADPVCLAKMYYSAVDPTKDIF  550

551  TGLIGPMKICKKGSLHANGRQKDVDKEFYLFPTVFDENESLLLEDNIRMF  600
     ||||||||||||||||||||||||||||||||||||||||||||||||||
551  TGLIGPMKICKKGSLHANGRQKDVDKEFYLFPTVFDENESLLLEDNIRMF  600

601  TTAPDQVDKEDEDFQESNKMHSMNGFMYGNQPGLTMCKGDSVVWYLFSAG  650
     ||||||||||||||||||||||||||||||||||||||||||||||||||
601  TTAPDQVDKEDEDFQESNKMHSMNGFMYGNQPGLTMCKGDSVVWYLFSAG  650

651  NEADVHGIYFSGNTYLWRGERRDTANLFPQTSLTLHMWPDTEGTFNVECL  700
     ||||||||||||||||||||||||||||||||||||||||||||||||||
651  NEADVHGIYFSGNTYLWRGERRDTANLFPQTSLTLHMWPDTEGTFNVECL  700

701  TTDHYTGGMKQKYTVNQCRRQSEDSTFYLGERTYYIAAVEVEWDYSPQRE  750
     ||||||||||||||||||||||||||||||||||||||||||||||||||
701  TTDHYTGGMKQKYTVNQCRRQSEDSTFYLGERTYYIAAVEVEWDYSPQRE  750

751  WEKELHHLQEQNVSNAFLDKGEFYIGSKYKKVVYRQYTDSTFRVPVERKA  800
     ||||||||||||||||||||||||||||||||||||||||||||||||||
751  WEKELHHLQEQNVSNAFLDKGEFYIGSKYKKVVYRQYTDSTFRVPVERKA  800

801  EEEHLGILGPQLHADVGDKVKIIFKNMATRPYSIHAHGVQTESSTCTPTL  850
     ||||||||||||||||||||||||||||||||||||||||||||||||||
801  EEEHLGILGPQLHADVGDKVKIIFKNMATRPYSIHAHGVQTESSTCTPTL  850

851  PGETLTYVWKIPERSGAGTEDSACIPWAYYSTVDQVKDLYSGLIGPLIVC  900
     ||||||||||||||||||||||||||||||||||||||||||||||||||
851  PGETLTYVWKIPERSGAGTEDSACIPWAYYSTVDQVKDLYSGLIGPLIVC  900

901  RRPYLKVFNPRRKLEFALLFLVFDENESWYLDDNIKTYSDHPEKVNKDDE  950
     ||||||||||||||||||||||||||||||||||||||||||||||||||
901  RRPYLKVFNPRRKLEFALLFLVFDENESWYLDDNIKTYSDHPEKVNKDDE  950

951  EFIESNKMHAINGRMFGNLQGLTMHVGDEVNWYLMGMGNEIDLHTVHFHG  1000
     ||||||||||||||||||||||||||||||||||||||||||||||||||
951  EFIESNKMHAINGRMFGNLQGLTMHVGDEVNWYLMGMGNEIDLHTVHFHG  1000

1001 HSFQYKHRGVYSSDVFDIFPGTYQTLEMFPRTPGIWLLHCHVTDHIHAGM  1050
     ||||||||||||||||||||||||||||||||||||||||||||||||||
1001 HSFQYKHRGVYSSDVFDIFPGTYQTLEMFPRTPGIWLLHCHVTDHIHAGM  1050

1051 ETTYTVLQNE  1060
     ||||||||||
1051 ETTYTVLQNE  1060
```

Sequence name: CERU_HUMAN

Sequence documentation:

Alignment of: HSCP2_PEA__1_P2 (SEQ ID NO: 850) x CERU_HUMAN ...

Alignment segment 1/1:
  Quality: 7636.00

Escore: 0

Matching length: 761 Total length: 761

Matching Percent Similarity: 100.00 Matching Percent Identity: 100.00

Total Percent Similarity: 100.00 Total Percent Identity: 100.00

Gaps: 0

Alignment:

```
  1  MKILILGIFLFLCSTPAWAKEKHYYIGIIETTWDYASDHGEKKLISVDTE  50
     ||||||||||||||||||||||||||||||||||||||||||||||||||
  1  MKILILGIFLFLCSTPAWAKEKHYYIGIIETTWDYASDHGEKKLISVDTE  50

51  HSNIYLQNGPDRIGRLYKKALYLQYTDETFRTTIEKPVWLGFLGPIIKAE  100
     ||||||||||||||||||||||||||||||||||||||||||||||||||
 51  HSNIYLQNGPDRIGRLYKKALYLQYTDETFRTTIEKPVWLGFLGPIIKAE  100

101  TGDKVYVHLKNLASRPYTFHSHGITYYKEHEGAIYPDNTTDFQRADDKVY  150
     ||||||||||||||||||||||||||||||||||||||||||||||||||
101  TGDKVYVHLKNLASRPYTFHSHGITYYKEHEGAIYPDNTTDFQRADDKVY  150
```

-continued

```
151 PGEQYTYMLLATEEQSPGEGDGNCVTRIYHSHIDAPKDIASGLIGPLIIC 200
    ||||||||||||||||||||||||||||||||||||||||||||||||||
151 PGEQYTYMLLATEEQSPGEGDGNCVTRIYHSHIDAPKDIASGLIGPLIIC 200

201 KKDSLDKEKEKHIDREFVVMFSVVDENFSWYLEDNIKTYCSEPEKVDKDN 250
    ||||||||||||||||||||||||||||||||||||||||||||||||||
201 KKDSLDKEKEKHIDREFVVMFSVVDENFSWYLEDNIKTYCSEPEKVDKDN 250

251 EDFQESNRMYSVNGYTFGSLPGLSMCAEDRVKWYLFGMGNEVDVHAAFFH 300
    ||||||||||||||||||||||||||||||||||||||||||||||||||
251 EDFQESNRMYSVNGYTFGSLPGLSMCAEDRVKWYLFGMGNEVDVHAAFFH 300

301 GQALTNKNYRIDTINLFPATLFDAYMVAQNPGEWMLSCQNLNHLKAGLQA 350
    ||||||||||||||||||||||||||||||||||||||||||||||||||
301 GQALTNKNYRIDTINLFPATLFDAYMVAQNPGEWMLSCQNLNHLKAGLQA 350

351 FFQVQECNKSSSKDNIRGKHVRHYYIAAEEIIWNYAOSGIDIFTKENLTA 400
    ||||||||||||||||||||||||||||||||||||||||||||||||||
351 FFQVQECNKSSSKDNIRGKHVRHYYIAAEEIIWNYAOSGIDIFTKENLTA 400

401 PGSDSAVFFEQGTTRIGGSYKKLVYREYTDASFTNRKERGPEEEHLGILG 450
    ||||||||||||||||||||||||||||||||||||||||||||||||||
401 PGSDSAVFFEQGTTRIGGSYKKLVYREYTDASFTNRKERGPEEEHLGILG 450

451 PVIWAEVGDTIRVTFHNKGAYPLSIEPIGVRFNKNNEGTYYSPNYNPQSR 500
    ||||||||||||||||||||||||||||||||||||||||||||||||||
451 PVIWAEVGDTIRVTFHNKGAYPLSIEPIGVRFNKNNEGTYYSPNYNPQSR 500

501 SVPPHASHVAPTETFTYEWTVPKEVGPTNADPVCLAKMYYSAVDPTKDIF 550
    ||||||||||||||||||||||||||||||||||||||||||||||||||
501 SVPPHASHVAPTETFTYEWTVPKEVGPTNADPVCLAKMYYSAVDPTKDIF 550

551 TGLIGPMKICKKGSLHANGRQKDVDKEFYLFPTVFDENESLLLEDNIRMF 600
    ||||||||||||||||||||||||||||||||||||||||||||||||||
551 TGLIGPMKICKKGSLHANGRQKDVDKEFYLFPTVFDENESLLLEDNIRMF 600

601 TTAPDQVDKEDEDFQESNKMHSMNGFMYGNQPGLTMCKGDSVVWYLFSAG 650
    ||||||||||||||||||||||||||||||||||||||||||||||||||
601 TTAPDQVDKEDEDFQESNKMHSMNGFMYGNQPGLTMCKGDSVVWYLFSAG 650

651 NEADVHGIYFSGNTYLWRGERRDTANLFPQTSLTLHMWPDTEGTFNVECL 700
    ||||||||||||||||||||||||||||||||||||||||||||||||||
651 NEADVHGIYFSGNTYLWRGERRDTANLFPQTSLTLHMWPDTEGTFNVECL 700

701 TTDHYTGGMKQKYTVNQCRRQSEDSTFYLGERTYYIAAVEVEWDYSPQRE 750
    ||||||||||||||||||||||||||||||||||||||||||||||||||
701 TTDHYTGGMKQKYTVNQCRRQSEDSTFYLGERTYYIAAVEVEWDYSPQRE 750

751 WEKELHHLQEQ 761
    |||||||||||
751 WEKELHHLQEQ 761
```

Sequence name: CERU_HUMAN

Sequence documentation:

Alignment of: HSCP2_PEA_1_P16 (SEQ ID NO: 851) x CERU_HUMAN . . .

Alignment segment 1/1:
  Quality: 10092.00

Escore: 0
  Matching length: 1007 Total length: 1007

Matching Percent Similarity: 100.00 Matching Percent Identity: 100.00

Total Percent Similarity: 100.00 Total Percent Identity: 100.00

Gaps: 0

Alignment:

```
  1 MKILILGIFLFLCSTPAWAKEKHYYIGIIETTWDYASDHGEKKLISVDTE 50
    ||||||||||||||||||||||||||||||||||||||||||||||||||
  1 MKILILGIFLFLCSTPAWAKEKHYYIGIIETTWDYASDHGEKKLISVDTE 50

51 HSNIYLQNGPDRIGRLYKKALYLQYTDETFRTTIEKPVWLGFLGPIIKAE 100
    ||||||||||||||||||||||||||||||||||||||||||||||||||
 51 HSNIYLQNGPDRIGRLYKKALYLQYTDETFRTTIEKPVWLGFLGPIIKAE 100
```

-continued

```
101  TGDKVYVHLKNLASRPYTFHSHGITYYKEHEGAIYPDNTTDFQRADDKVY  150
     ||||||||||||||||||||||||||||||||||||||||||||||||||
101  TGDKVYVHLKNLASRPYTFHSHGITYYKEHEGAIYPDNTTDFQRADDKVY  150

151  PGEQYTYMLLATEEQSPGEGDGNCVTRIYHSHIDAPKDIASGLIGPLIIC  200
     ||||||||||||||||||||||||||||||||||||||||||||||||||
151  PGEQYTYMLLATEEQSPGEGDGNCVTRIYHSHIDAPKDIASGLIGPLIIC  200

201  KKDSLDKEKEKHIDREFVVMFSVVDENFSWYLEDNIKTYCSEPEKVDKDN  250
     ||||||||||||||||||||||||||||||||||||||||||||||||||
201  KKDSLDKEKEKHIDREFVVMFSVVDENFSWYLEDNIKTYCSEPEKVDKDN  250

251  EDFQESNRMYSVNGYTFGSLPGLSMCAEDRVKWYLFGMGNEVDVHAAFFH  300
     ||||||||||||||||||||||||||||||||||||||||||||||||||
251  EDFQESNRMYSVNGYTFGSLPGLSMCAEDRVKWYLFGMGNEVDVHAAFFH  300

301  GQALTNKNYRIDTINLFPATLFDAYMVAQNPGEWMLSCQNLNHLKAGLQA  350
     ||||||||||||||||||||||||||||||||||||||||||||||||||
301  GQALTNKNYRIDTINLFPATLFDAYMVAQNPGEWMLSCQNLNHLKAGLQA  350

351  FFQVQECNKSSSKDNIRGKHVRHYYIAAEEIIWNYAOSGIDIFTKENLTA  400
     ||||||||||||||||||||||||||||||||||||||||||||||||||
351  FFQVQECNKSSSKDNIRGKHVRHYYIAAEEIIWNYAOSGIDIFTKENLTA  400

401  PGSDSAVFFEQGTTRIGGSYKKLVYREYTDASFTNRKERGPEEEHLGILG  450
     ||||||||||||||||||||||||||||||||||||||||||||||||||
401  PGSDSAVFFEQGTTRIGGSYKKLVYREYTDASFTNRKERGPEEEHLGILG  450

451  PVIWAEVGDTIRVTFHNKGAYPLSIEPIGVRFNKNNEGTYYSPNYNPQSR  500
     ||||||||||||||||||||||||||||||||||||||||||||||||||
451  PVIWAEVGDTIRVTFHNKGAYPLSIEPIGVRFNKNNEGTYYSPNYNPQSR  500

501  SVPPHASHVAPTETFTYEWTVPKEVGPTNADPVCLAKMYYSAVDPTKDIF  550
     ||||||||||||||||||||||||||||||||||||||||||||||||||
501  SVPPHASHVAPTETFTYEWTVPKEVGPTNADPVCLAKMYYSAVDPTKDIF  550

551  TGLIGPMKICKKGSLHANGRQKDVDKEFYLFPTVFDENESLLLEDNIRMF  600
     ||||||||||||||||||||||||||||||||||||||||||||||||||
551  TGLIGPMKICKKGSLHANGRQKDVDKEFYLFPTVFDENESLLLEDNIRMF  600

601  TTAPDQVDKEDEDFQESNKMHSMNGFMYGNQPGLTMCKGDSVVWYLFSAG  650
     ||||||||||||||||||||||||||||||||||||||||||||||||||
601  TTAPDQVDKEDEDFQESNKMHSMNGFMYGNQPGLTMCKGDSVVWYLFSAG  650

651  NEADVHGIYFSGNTYLWRGERRDTANLFPQTSLTLHMWPDTEGTFNVECL  700
     ||||||||||||||||||||||||||||||||||||||||||||||||||
651  NEADVHGIYFSGNTYLWRGERRDTANLFPQTSLTLHMWPDTEGTFNVECL  700

701  TTDHYTGGMKQKYTVNQCRRQSEDSTFYLGERTYYIAAVEVEWDYSPQRE  750
     ||||||||||||||||||||||||||||||||||||||||||||||||||
701  TTDHYTGGMKQKYTVNQCRRQSEDSTFYLGERTYYIAAVEVEWDYSPQRE  750

751  WEKELHHLQEQNVSNAFLDKGEFYIGSKYKKVVYRQYTDSTFRVPVERKA  800
     ||||||||||||||||||||||||||||||||||||||||||||||||||
751  WEKELHHLQEQNVSNAFLDKGEFYIGSKYKKVVYRQYTDSTFRVPVERKA  800

801  EEEHLGILGPQLHADVGDKVKIIFKNMATRPYSIHAHGVQTESSTCTPTL  850
     ||||||||||||||||||||||||||||||||||||||||||||||||||
801  EEEHLGILGPQLHADVGDKVKIIFKNMATRPYSIHAHGVQTESSTCTPTL  850

851  PGETLTYVWKIPERSGAGTEDSACIPWAYYSTVDQVKDLYSGLIGPLIVC  900
     ||||||||||||||||||||||||||||||||||||||||||||||||||
851  PGETLTYVWKIPERSGAGTEDSACIPWAYYSTVDQVKDLYSGLIGPLIVC  900

901  RRPYLKVFNPRRKLEFALLFLVFDENESWYLDDNIKTYSDHPEKVNKDDE  950
     ||||||||||||||||||||||||||||||||||||||||||||||||||
901  RRPYLKVFNPRRKLEFALLFLVFDENESWYLDDNIKTYSDHPEKVNKDDE  950

951  EFIESNKMHAINGRMFGNLQGLTMHVGDEVNWYLMGMGNEIDLHTVHFHG  1000
     ||||||||||||||||||||||||||||||||||||||||||||||||||
951  EFIESNKMHAINGRMFGNLQGLTMHVGDEVNWYLMGMGNEIDLHTVHFHG  1000

1001 HSFQYKH  1007
     |||||||
1001 HSFQYKH  1007
```

Sequence name: CERU_HUMAN

Sequence documentation:

Alignment of: HSCP2_PEA__1_P6 (SEQ ID NO: 852) x CERU_HUMAN . . .

Alignment segment 1/1:
  Quality: 10079.00

Escore: 0
  Matching length: 1006 Total length: 1006

Matching Percent Similarity: 100.00 Matching Percent Identity: 100.00

Total Percent Similarity: 100.00 Total Percent Identity: 100.00

Gaps: 0

Alignment:

```
  1 MKILILGIFLFLCSTPAWAKEKHYYIGIIETTWDYASDHGEKKLISVDTE  50
    ||||||||||||||||||||||||||||||||||||||||||||||||||
  1 MKILILGIFLFLCSTPAWAKEKHYYIGIIETTWDYASDHGEKKLISVDTE  50

51 HSNIYLQNGPDRIGRLYKKALYLQYTDETFRTTIEKPVWLGFLGPIIKAE 100
    ||||||||||||||||||||||||||||||||||||||||||||||||||
 51 HSNIYLQNGPDRIGRLYKKALYLQYTDETFRTTIEKPVWLGFLGPIIKAE 100

101 TGDKVYVHLKNLASRPYTFHSHGITYYKEHEGAIYPDNTTDFQRADDKVY 150
    ||||||||||||||||||||||||||||||||||||||||||||||||||
101 TGDKVYVHLKNLASRPYTFHSHGITYYKEHEGAIYPDNTTDFQRADDKVY 150

151 PGEQYTYMLLATEEQSPGEGDGNCVTRIYHSHIDAPKDIASGLIGPLIIC 200
    ||||||||||||||||||||||||||||||||||||||||||||||||||
151 PGEQYTYMLLATEEQSPGEGDGNCVTRIYHSHIDAPKDIASGLIGPLIIC 200

201 KKDSLDKEKEKHIDREFVVMFSVVDENFSWYLEDNIKTYCSEPEKVDKDN 250
    ||||||||||||||||||||||||||||||||||||||||||||||||||
201 KKDSLDKEKEKHIDREFVVMFSVVDENFSWYLEDNIKTYCSEPEKVDKDN 250

251 EDFQESNRMYSVNGYTFGSLPGLSMCAEDRVKWYLFGMGNEVDVHAAFFH 300
    ||||||||||||||||||||||||||||||||||||||||||||||||||
251 EDFQESNRMYSVNGYTFGSLPGLSMCAEDRVKWYLFGMGNEVDVHAAFFH 300

301 GQALTNKNYRIDTINLFPATLFDAYMVAQNPGEWMLSCQNLNHLKAGLQA 350
    ||||||||||||||||||||||||||||||||||||||||||||||||||
301 GQALTNKNYRIDTINLFPATLFDAYMVAQNPGEWMLSCQNLNHLKAGLQA 350

351 FFQVQECNKSSSKDNIRGKHVRHYYIAAEEIIWNYAOSGIDIFTKENLTA 400
    ||||||||||||||||||||||||||||||||||||||||||||||||||
351 FFQVQECNKSSSKDNIRGKHVRHYYIAAEEIIWNYAOSGIDIFTKENLTA 400

401 PGSDSAVFFEQGTTRIGGSYKKLVYREYTDASFTNRKERGPEEEHLGILG 450
    ||||||||||||||||||||||||||||||||||||||||||||||||||
401 PGSDSAVFFEQGTTRIGGSYKKLVYREYTDASFTNRKERGPEEEHLGILG 450

451 PVIWAEVGDTIRVTFHNKGAYPLSIEPIGVRFNKNNEGTYYSPNYNPQSR 500
    ||||||||||||||||||||||||||||||||||||||||||||||||||
451 PVIWAEVGDTIRVTFHNKGAYPLSIEPIGVRFNKNNEGTYYSPNYNPQSR 500

501 SVPPHASHVAPTETFTYEWTVPKEVGPTNADPVCLAKMYYSAVDPTKDIF 550
    ||||||||||||||||||||||||||||||||||||||||||||||||||
501 SVPPHASHVAPTETFTYEWTVPKEVGPTNADPVCLAKMYYSAVDPTKDIF 550

551 TGLIGPMKICKKGSLHANGRQKDVDKEFYLFPTVFDENESLLLEDNIRMF 600
    ||||||||||||||||||||||||||||||||||||||||||||||||||
551 TGLIGPMKICKKGSLHANGRQKDVDKEFYLFPTVFDENESLLLEDNIRMF 600

601 TTAPDQVDKEDEDFQESNKMHSMNGFMYGNQPGLTMCKGDSVVWYLFSAG 650
    ||||||||||||||||||||||||||||||||||||||||||||||||||
601 TTAPDQVDKEDEDFQESNKMHSMNGFMYGNQPGLTMCKGDSVVWYLFSAG 650

651 NEADVHGIYFSGNTYLWRGERRDTANLFPQTSLTLHMWPDTEGTFNVECL 700
    ||||||||||||||||||||||||||||||||||||||||||||||||||
651 NEADVHGIYFSGNTYLWRGERRDTANLFPQTSLTLHMWPDTEGTFNVECL 700

701 TTDHYTGGMKQKYTVNQCRRQSEDSTFYLGERTYYIAAVEVEWDYSPQRE 750
    ||||||||||||||||||||||||||||||||||||||||||||||||||
701 TTDHYTGGMKQKYTVNQCRRQSEDSTFYLGERTYYIAAVEVEWDYSPQRE 750

751 WEKELHHLQEQNVSNAFLDKGEFYIGSKYKKVVYRQYTDSTFRVPVERKA 800
    ||||||||||||||||||||||||||||||||||||||||||||||||||
751 WEKELHHLQEQNVSNAFLDKGEFYIGSKYKKVVYRQYTDSTFRVPVERKA 800

801 EEEHLGILGPQLHADVGDKVKIIFKNMATRPYSIHAHGVQTESSTCTPTL 850
    ||||||||||||||||||||||||||||||||||||||||||||||||||
801 EEEHLGILGPQLHADVGDKVKIIFKNMATRPYSIHAHGVQTESSTCTPTL 850
```

-continued

```
851  PGETLTYVWKIPERSGAGTEDSACIPWAYYSTVDQVKDLYSGLIGPLIVC  900
     ||||||||||||||||||||||||||||||||||||||||||||||||||
851  PGETLTYVWKIPERSGAGTEDSACIPWAYYSTVDQVKDLYSGLIGPLIVC  900

901  RRPYLKVFNPRRKLEFALLFLVFDENESWYLDDNIKTYSDHPEKVNKDDE  950
     ||||||||||||||||||||||||||||||||||||||||||||||||||
901  RRPYLKVFNPRRKLEFALLFLVFDENESWYLDDNIKTYSDHPEKVNKDDE  950

951  EFIESNKMHAINGRMFGNLQGLTMHVGDEVNWYLMGMGNEIDLHTVHFHG  1000
     ||||||||||||||||||||||||||||||||||||||||||||||||||
951  EFIESNKMHAINGRMFGNLQGLTMHVGDEVNWYLMGMGNEIDLHTVHFHG  1000

1001 HSFQYK                                              1006
     ||||||
1001 HSFQYK                                              1006
```

Sequence name: CERU_HUMAN

Sequence documentation:

Alignment of: HSCP2_PEA__1_P2 (SEQ ID NO: 850)2 x CERU_HUMAN . . .

Alignment segment 1/1:
Quality: 9277.00

Escore: 0
Matching length: 936 Total length: 1065

Matching Percent Similarity: 100.00 Matching Percent Identity: 99.89

Total Percent Similarity: 87.89 Total Percent Identity: 87.79

Gaps: 1

Alignment:

```
  1  MKILILGIFLFLCSTPAWAKEKHYYIDIIETTWDYASDHGEKKLISVDTE   50
     |||||||||||||||||||||||||  |||||||||||||||||||||||
  1  MKILILGIFLFLCSTPAWAKEKHYYIGIIETTWDYASDHGEKKLISVDTE   50

51  HSNIYLQNGPDRIGRLYKKALYLQYTDETFRTTIEKPVWLGFLGPIIKAE  100
     ||||||||||||||||||||||||||||||||||||||||||||||||||
 51  HSNIYLQNGPDRIGRLYKKALYLQYTDETFRTTIEKPVWLGFLGPIIKAE  100

101  TGDKVYVHLKNLASRPYTFHSHGITYYKEHE...................  131
     |||||||||||||||||||||||||||||||
101  TGDKVYVHLKNLASRPYTFHSHGITYYKEHEGAIYPDNTTDFQRADDKVY  150

131  ..................................................  131

151  PGEQYTYMLLATEEQSPGEGDGNCVTRIYHSHIDAPKDIASGLIGPLIIC  200

131  ..................................................  131

201  KKDSLDKEKEKHIDREFVVMFSVVDENFSWYLEDNIKTYCSEPEKVDKDN  250

132  ..........AVNGYTFGSLPGLSMCAEDRVKWYLFGMGNEVDVHAARRH  171
               :|||||||||||||||||||||||||||||||||||||||
251  EDGQESNRMYSVNGYTFGSLPGLSMCAEDRVKWYLFGMGNEVDVHAAFFH  300

172  GQALTNKNYRIDTINLFPATLFDAYMVAQNPGEWMLSCQNLNHLKAGLQA  221
     ||||||||||||||||||||||||||||||||| ||||||||||||||||
301  GQALTNKNYRIDTINLFPATLFDAYMVAQNPGEWNLSCQNLNHLKAGLQA  350

222  FFQVQECNKSSSKDNIRGKHVRHYYIAAEEIIWNYAPSGIDIFTKENLTA  271
     ||||||||||||||||||||||||||||||||||||||||||||||||||
351  FFQVQECNKSSSKDNIRGKHVRHYYIAAEEIIWNYAPSGIDIFTKENLTA  400

272  PGSDSAVRREQGTTRIGGSYKKLVYREYTDASFTNRKERGPEEEHLGILG  321
     ||||||||||||||||||||||||||||||||||||||||||||||||||
401  PGSDSAVRREQGTTRIGGSYKKLVYREYTDASFTNRKERGPEEEHLGILG  450

322  PVIWAEVGDTIRVTFHNKGAYPLSIEPIGVRFNKNNEGTYYSPNYNPQSR  371
     ||||||||||||||||||||||||||||||||||||||||||||||||||
451  PVIWAEVGDTIRVTFHNKGAYPLSIEPIGVRFNKNNEGTYYSPNYNPQSR  500
```

-continued

```
 372  SVPPSASHVAPTETFTYEWTVPKEVGPTNADPVCLAKMYYSAVDPTKDIF   421
      ||||||||||||||||||||||||||||||||||||||||||||||||||
 501  SVPPSASHVAPTETFTYEWTVPKEVGPTNADPVCLAKMYYSAVDPTKDIF   550

422  TGLIGPMKICKKGSLHANGRQKDVDKEFYLFPTVFDENESLLLEDNIRMF    471
      |||||||||||||||||||||||||||||||||||||||||||||||||
 551  TGLIGPMKICKKGSLHANGRQKDVDKEFYLFPTVFDENESLLLEDNIRMF    600

472  TTAPDQVDKEDEDFQESNKMHSMNGFMYGNQPGLTMCKGDSVVWYLFSAG    521
      |||||||||||||||||||||||||||||||||||||||||||||||||
 601  TTAPDQVDKEDEDFQESNKMHSMNGFMYGNQPGLTMCKGDSVVWYLFSAG    650

522  NEADVHGIYFSGNTYLWRGERRDTANLFPQTSLTLHMWPDTEGTFNVECL    571
      |||||||||||||||||||||||||||||||||||||||||||||||||
 651  NEADVHGIYFSGNTYLWRGERRDTANLFPQTSLTLHMWPDTEGTFNVECL    700

572  TTDHYTGGMKQKYTVNQCRRQSEDSTFYLGERTYYIAAVEVEWDYSPQRE    621
      |||||||||||||||||||||||||||||||||||||||||||||||||
 701  TTDHYTGGMKQKYTVNQCRRQSEDSTFYLGERTYYIAAVEVEWDYSPQRE    750

622  WEKELHHLQEQNVSNAFLDKGEFYIGSKYKKVVYRQYTDSTFRVPVERKA    671
      |||||||||||||||||||||||||||||||||||||||||||||||||
 751  WEKELHHLQEQNVSNAFLDKGEFYIGSKYKKVVYRQYTDSTFRVPVERKA    800

672  EEEHLGILGPQLHADVGDKVKIIFKNMATRPYSIHAHGVQTESSTVTPTL    721
      |||||||||||||||||||||||||||||||||||||||||||||||||
 801  EEEHLGILGPQLHADVGDKVKIIFKNMATRPYSIHAHGVQTESSTVTPTL    850

722  PGETLTYVWKIPERSGAGTEDSACIPWAYYSTVDQVKDLYSGLIGPLIVC    771
      |||||||||||||||||||||||||||||||||||||||||||||||||
 851  PGETLTYVWKIPERSGAGTEDSACIPWAYYSTVDQVKDLYSGLIGPLIVC    900

772  RRPYLKVFNPRRKLEFALLFLVFDENESWYLDDNIKTYSDHPEKVNKDDE    821
      |||||||||||||||||||||||||||||||||||||||||||||||||
 901  RRPYLKVFNPRRKLEFALLFLVFDENESWYLDDNIKTYSDHPEKVNKDDE    950

822  EFIESNKMHAINGRMFGNLQGLTMHVGDEVNWYLMGMGNEIDLHTVHFHG    871
      |||||||||||||||||||||||||||||||||||||||||||||||||
 951  EFIESNKMHAINGRMFGNLQGLTMHVGDEVNWYLMGMGNEIDLHTVHFHG   1000

872  HSFQYKHRGVYSSDVFDIFPGTYQTLEMFPRTPGIWLLHCHVTDHIHAGM    921
      |||||||||||||||||||||||||||||||||||||||||||||||||
1001  HSFQYKHRGVYSSDVFDIFPGTYQTLEMFPRTPGIWLLHCHVTDHIHAGM   1050

922  ETTYTVLQNEDTKSG                                      936
      |||||||||||||||
1051  ETTYTVLQNEDTKSG                                     1065
```

Sequence name: CERU_HUMAN

Sequence documentation:

Alignment of: HSCP2_PEA_1_P2 (SEQ ID NO: 850)4 x CERU_HUMAN . . .

Alignment segment 1/1:
  Quality: 8074.00

Escore: 0
  Matching length: 804 Total length: 804

Matching Percent Similarity: 100.00 Matching Percent Identity: 100.00
  Total Percent Similarity: 100.00 Total Percent Identity: 100.00
  Gaps: 0

Alignment:

```
  16  VNGYTFGSLPGLSMCAEDRVKWYLFGMGNEVDVHAAFFHGQALTNKNYRI    65
      |||||||||||||||||||||||||||||||||||||||||||||||||
 262  VNGYTFGSLPGLSMCAEDRVKWYLFGMGNEVDVHAAFFHGQALTNKNYRI   311

66  DTINLFPATLRDAYMVAQNPGEWMLSCQNLNHLKAGLQAFFQVQECNKSS   115
      |||||||||||||||||||||||||||||||||||||||||||||||||
 312  DTINLFPATLFDAYMVAQNPGEWMLSCQNLNHLKAGLQAFFQVQECNKSS   361

116  SKDNIRGKHVRHYYIAAEEIIWNYAPSGIDIFTKENLTAPGSDSAVFFEQ   165
      |||||||||||||||||||||||||||||||||||||||||||||||||
 362  SKDNIRGKHVRHYYIAAEEIIWNYAPSGIDIFTKENLTAPGSDSAVFFEQ   411
```

-continued

```
 166  GTTRIGGSYKKLVYREYTDASFTNRKERGPEEEHLGILGPVIWAEVGDTI   215
      ||||||||||||||||||||||||||||||||||||||||||||||||||
 412  GTTRIGGSYKKLVYREYTDASFTNRKERGPEEEHLGILGPVIWAEVGDTI   461

216  RVTFHNKGAYPLSIEPIGVRFNKNNEGTYYSPNYNPQSRSVPPSASHVAP   265
      |||||||||||||||||||||||||||||||||||||||||||||||||
 462  RVTFHNKGAYPLSIEPIGVRFNKNNEGTYYSPNYNPQSRSVPPSASHVAP   511

266  TETFTYEWTVPKEVGPTNADPVCLAKMYYSAVDPTKDIFTGLIGPMKICK   315
      |||||||||||||||||||||||||||||||||||||||||||||||||
 512  TETFTYEWTVPKEVGPTNADPVCLAKMYYSAVDPTKDIFTGLIGPMKICK   561

316  KGSLHANGRQKDVDKEFYLFPTVFDENESLLLEDNIRMFTTAPDQVDKED   365
      |||||||||||||||||||||||||||||||||||||||||||||||||
 562  KGSLHANGRQKDVDKEFYLFPTVFDENESLLLEDNIRMFTTAPDQVDKED   611

366  EDFQESNKMHSMNGFMYGNQPGLTMCKGDSVVWYLFSAGNEADVHGIYFS   415
      |||||||||||||||||||||||||||||||||||||||||||||||||
 612  EDFQESNKMHSMNGFMYGNQPGLTMCKGDSVVWYLFSAGNEADVHGIYFS   661

416  GNTYLWRGERRDTANLFPQTSLTLHMWPDTEGTFNVECLTTDHYTGGMKQ   465
      |||||||||||||||||||||||||||||||||||||||||||||||||
 662  GNTYLWRGERRDTANLFPQTSLTLHMWPDTEGTFNVECLTTDHYTGGMKQ   711

466  KYTVNQCRRQSEDSTFYLGERTYYIAAVEVEWDYSPQREWEKELHHLQEQ   515
      |||||||||||||||||||||||||||||||||||||||||||||||||
 712  KYTVNQCRRQSEDSTFYLGERTYYIAAVEVEWDYSPQREWEKELHHLQEQ   761

516  NVSNAFLDKGEFYIGSKYKKVVYRQYTDSTFRVPVERKAEEEHLGILGPQ   565
      |||||||||||||||||||||||||||||||||||||||||||||||||
 762  NVSNAFLDKGEFYIGSKYKKVVYRQYTDSTFRVPVERKAEEEHLGILGPQ   811

566  LHQDVGDKVKIIFKNMATRPYSIHAHGVQTESSTVTPTLPGETLTYVWKI   615
      || |||||||||||||||||||||||||||||||||||||||||||||
 812  LHADVGDKVKIIFKNMATRPYSIHAHGVQTESSTVTPTLPGETLTYVWKI   861

616  PERSGAGTEDSACIPWAYYSTVDQVKDLYSGLIGPLIVCRRPYLKVFNPR   665
      |||||||||||||||||||||||||||||||||||||||||||||||||
 862  PERSGAGTEDSACIPWAYYSTVDQVKDLYSGLIGPLIVCRRPYLKVFNPR   911

666  RKLEFALLFLVFDENESWYLDDNIKTYSDHPEKVNKDDEEFIESNKMHAI   715
      |||||||||||||||||||||||||||||||||||||||||||||||||
 912  RKLEFALLFLVFDENESWYLDDNIKTYSDHPEKVNKDDEEFIESNKMHAI   961

716  NGRMFGNLQGLTMHVGDEVNWYLMGMGNEIDLHTVHFHGHSFQYKHRGVY   765
      |||||||||||||||||||||||||||||||||||||||||||||||||
 962  NGRMFGNLQGLTMHVGDEVNWYLMGMGNEIDLHTVHFHGHSFQYKHRGVY   1011

766  SSDVFDIFPGTYQTLEMFPRTPGIWLLHCHVTDHIHAGMETTYTVLQNED   815
      |||||||||||||||||||||||||||||||||||||||||||||||||
1012  SSDVFDIFPGTYQTLEMFPRTPGIWLLHCHVTDHIHAGMETTYTVLQNED   1061

816  TKSG   819
      ||||
1062  TKSG   1065
```

Sequence name: CERU_HUMAN

Sequence documentation:

Alignment of: HSCP2_PEA__1_P2 (SEQ ID NO: 850)5 x CERU_HUMAN ...

Alignment segment 1/1:
 Quality: 6196.00

Escore: 0
 Matching length: 621 Total length: 621

Matching Percent Similarity: 100.00 Matching Percent Identity: 100.00

Total Percent Similarity: 100.00 Total Percent Identity: 100.00

Gaps: 0

Alignment:

```
  1  MKILILGIFLFLCSTPAWAKEKHYYIGIIETTWDYASDHGEKKLISVDTE   50
     |||||||||||||||||||||||||||||||||||||||||||||||||
  1  MKILILGIFLFLCSTPAWAKEKHYYIGIIETTWDYASDHGEKKLISVDTE   50

51  HSNIYLQNGPDRIGRLYKKALYLQYTDETFRTTIEKPVWLGFLGPIIKAE   100
     |||||||||||||||||||||||||||||||||||||||||||||||||
 51  HSNIYLQNGPDRIGRLYKKALYLQYTDETFRTTIEKPVWLGFLGPIIKAE   100
```

-continued

```
101  TGDKVYVHLKNLASRPYTFHSHGITYYKEHEGAIYPDNTTDFQRADDKVY  150
     ||||||||||||||||||||||||||||||||||||||||||||||||||
101  TGDKVYVHLKNLASRPYTFHSHGITYYKEHEGAIYPDNTTDFQRADDKVY  150

151  PGEQYTYMLLATEEQSPGEGDGNCVTRIYHSHIDAPKDIASGLIGPLIIC  200
     ||||||||||||||||||||||||||||||||||||||||||||||||||
151  PGEQYTYMLLATEEQSPGEGDGNCVTRIYHSHIDAPKDIASGLIGPLIIC  200

201  KKDSLDKEKEKHIDREFVVMFSVVDENFSWYLEDNIKTYCSEPEKVDKDN  250
     ||||||||||||||||||||||||||||||||||||||||||||||||||
201  KKDSLDKEKEKHIDREFVVMFSVVDENFSWYLEDNIKTYCSEPEKVDKDN  250

251  EDFQESNRMYSVNGYTFGSLPGLSMCAEDRVKWYLFGMGNEVDVHAAFFH  300
     ||||||||||||||||||||||||||||||||||||||||||||||||||
251  EDFQESNRMYSVNGYTFGSLPGLSMCAEDRVKWYLFGMGNEVDVHAAFFH  300

301  GQALTNKNYRIDTINLFPATLFDAYMVAQNPGEWMLSCQNLNHLKAGLQA  350
     ||||||||||||||||||||||||||||||||||||||||||||||||||
301  GQALTNKNYRIDTINLFPATLFDAYMVAQNPGEWMLSCQNLNHLKAGLQA  350

351  FFQVQECNKSSSKDNIRGKHVRHYYIAAEEIIWNYAPSGIDIFTKENLTA  400
     ||||||||||||||||||||||||||||||||||||||||||||||||||
351  FFQVQECNKSSSKDNIRGKHVRHYYIAAEEIIWNYAPSGIDIFTKENLTA  400

401  PGSDSAVFFEQGTTRIGGSYKKLVYREYTDASFTNRKERGPEEEHLGILG  450
     ||||||||||||||||||||||||||||||||||||||||||||||||||
401  PGSDSAVFFEQGTTRIGGSYKKLVYREYTDASFTNRKERGPEEEHLGILG  450

451  PVIWAEVGDTIRVTFHNKGAYPLSIEPIGVRFNKNNEGTYYSPNYNPQSR  500
     ||||||||||||||||||||||||||||||||||||||||||||||||||
451  PVIWAEVGDTIRVTFHNKGAYPLSIEPIGVRFNKNNEGTYYSPNYNPQSR  500

501  SVPPSASHVAPTETFTYEWTVPKEVGPTNADPVCLAKMYYSAVDPTKDIF  550
     ||||||||||||||||||||||||||||||||||||||||||||||||||
501  SVPPSASHVAPTETFTYEWTVPKEVGPTNADPVCLAKMYYSAVDPTKDIF  550

551  TGLIGPMKICKKGSLHANGRQKDVDKEFYLFPTVFDENESLLLEDNIRMF  600
     ||||||||||||||||||||||||||||||||||||||||||||||||||
551  TGLIGPMKICKKGSLHANGRQKDVDKEFYLFPTVFDENESLLLEDNIRMF  600

601  TTAPDQVDKEDEDFQESNKMH                              621
     |||||||||||||||||||||
601  TTAPDQVDKEDEDFQESNKMH                              621
```

Sequence name: CERU_HUMAN

Sequence documentation:

Alignment of: HSCP2_PEA_1_P33 (SEQ ID NO: 856) x CERU_HUMAN . . .

Alignment segment 1/1:
  Quality: 2003.00
Escore: 0
  Matching length: 202 Total length: 202

Matching Percent Similarity: 100.00 Matching Percent Identity: 100.00
  Total Percent Similarity: 100.00 Total Percent Identity: 100.00
  Gaps: 0

Alignment:

```
  1  MKILILGIFLFLCSTPAWAKEKHYYIGIIETTWDYASDHGEKKLISVDTE   50
     ||||||||||||||||||||||||||||||||||||||||||||||||||
  1  MKILILGIFLFLCSTPAWAKEKHYYIGIIETTWDYASDHGEKKLISVDTE   50

51  HSNIYLQNGPDRIGRLYKKALYLQYTDETFRTTIEKPVWLGFLGPIIKAE  100
     ||||||||||||||||||||||||||||||||||||||||||||||||||
 51  HSNIYLQNGPDRIGRLYKKALYLQYTDETFRTTIEKPVWLGFLGPIIKAE  100

101  TGDKVYVHLKNLASRPYTFHSHGITYYKEHEGAIYPDNTTDFQRADDKVY  150
     ||||||||||||||||||||||||||||||||||||||||||||||||||
101  TGDKVYVHLKNLASRPYTFHSHGITYYKEHEGAIYPDNTTDFQRADDKVY  150

151  PGEQYTYMLLATEEQSPGEGDGNCVTRIYHSHIDAPKDIASGLIGPLIIC  200
     ||||||||||||||||||||||||||||||||||||||||||||||||||
151  PGEQYTYMLLATEEQSPGEGDGNCVTRIYHSHIDAPKDIASGLIGPLIIC  200
```

```
201  KK                                          202
     ||
201  KK                                          202
```

DESCRIPTION FOR CLUSTER HUMTEN

Cluster HUMTEN features 19 transcript(s) and 57 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| HUMTEN_PEA_1_T4 | 857 |
| HUMTEN_PEA_1_T5 | 858 |
| HUMTEN_PEA_1_T6 | 859 |
| HUMTEN_PEA_1_T7 | 860 |
| HUMTEN_PEA_1_T11 | 861 |
| HUMTEN_PEA_1_T14 | 862 |
| HUMTEN_PEA_1_T16 | 863 |
| HUMTEN_PEA_1_T17 | 864 |
| HUMTEN_PEA_1_T18 | 865 |
| HUMTEN_PEA_1_T19 | 866 |
| HUMTEN_PEA_1_T20 | 867 |
| HUMTEN_PEA_1_T23 | 868 |
| HUMTEN_PEA_1_T32 | 869 |
| HUMTEN_PEA_1_T35 | 870 |
| HUMTEN_PEA_1_T36 | 871 |
| HUMTEN_PEA_1_T37 | 872 |
| HUMTEN_PEA_1_T39 | 873 |
| HUMTEN_PEA_1_T40 | 874 |
| HUMTEN_PEA_1_T41 | 875 |

TABLE 2

Segments of interest

| Segment Name | SEQ ID NO: |
|---|---|
| HUMTEN_PEA_1_node_0 | 876 |
| HUMTEN_PEA_1_node_2 | 877 |
| HUMTEN_PEA_1_node_5 | 878 |
| HUMTEN_PEA_1_node_6 | 879 |
| HUMTEN_PEA_1_node_11 | 880 |
| HUMTEN_PEA_1_node_12 | 881 |
| HUMTEN_PEA_1_node_16 | 882 |
| HUMTEN_PEA_1_node_19 | 883 |
| HUMTEN_PEA_1_node_23 | 884 |
| HUMTEN_PEA_1_node_27 | 885 |
| HUMTEN_PEA_1_node_28 | 886 |
| HUMTEN_PEA_1_node_30 | 887 |
| HUMTEN_PEA_1_node_32 | 888 |
| HUMTEN_PEA_1_node_33 | 889 |
| HUMTEN_PEA_1_node_35 | 890 |
| HUMTEN_PEA_1_node_38 | 891 |
| HUMTEN_PEA_1_node_40 | 892 |
| HUMTEN_PEA_1_node_42 | 893 |
| HUMTEN_PEA_1_node_43 | 894 |
| HUMTEN_PEA_1_node_44 | 895 |
| HUMTEN_PEA_1_node_45 | 896 |
| HUMTEN_PEA_1_node_46 | 897 |
| HUMTEN_PEA_1_node_47 | 898 |
| HUMTEN_PEA_1_node_49 | 899 |
| HUMTEN_PEA_1_node_51 | 900 |
| HUMTEN_PEA_1_node_56 | 901 |
| HUMTEN_PEA_1_node_65 | 902 |
| HUMTEN_PEA_1_node_71 | 903 |
| HUMTEN_PEA_1_node_73 | 904 |

TABLE 2-continued

Segments of interest

| Segment Name | SEQ ID NO: |
|---|---|
| HUMTEN_PEA_1_node_76 | 905 |
| HUMTEN_PEA_1_node_79 | 906 |
| HUMTEN_PEA_1_node_83 | 907 |
| HUMTEN_PEA_1_node_89 | 908 |
| HUMTEN_PEA_1_node_7 | 909 |
| HUMTEN_PEA_1_node_8 | 910 |
| HUMTEN_PEA_1_node_9 | 911 |
| HUMTEN_PEA_1_node_14 | 912 |
| HUMTEN_PEA_1_node_17 | 913 |
| HUMTEN_PEA_1_node_21 | 914 |
| HUMTEN_PEA_1_node_22 | 915 |
| HUMTEN_PEA_1_node_25 | 916 |
| HUMTEN_PEA_1_node_36 | 917 |
| HUMTEN_PEA_1_node_53 | 918 |
| HUMTEN_PEA_1_node_54 | 919 |
| HUMTEN_PEA_1_node_57 | 920 |
| HUMTEN_PEA_1_node_61 | 921 |
| HUMTEN_PEA_1_node_62 | 922 |
| HUMTEN_PEA_1_node_67 | 923 |
| HUMTEN_PEA_1_node_68 | 924 |
| HUMTEN_PEA_1_node_69 | 925 |
| HUMTEN_PEA_1_node_70 | 926 |
| HUMTEN_PEA_1_node_72 | 927 |
| HUMTEN_PEA_1_node_84 | 928 |
| HUMTEN_PEA_1_node_85 | 929 |
| HUMTEN_PEA_1_node_86 | 930 |
| HUMTEN_PEA_1_node_87 | 931 |
| HUMTEN_PEA_1_node_88 | 932 |

TABLE 3

Proteins of interest

| Protein Name | SEQ ID NO: | Corresponding Transcript(s) |
|---|---|---|
| HUMTEN_PEA_1_P5 | 934 | HUMTEN_PEA_1_T4 (SEQ ID NO: 857) |
| HUMTEN_PEA_1_P6 | 935 | HUMTEN_PEA_1_T5 (SEQ ID NO: 858) |
| HUMTEN_PEA_1_P7 | 936 | HUMTEN_PEA_1_T6 (SEQ ID NO: 859) |
| HUMTEN_PEA_1_P8 | 937 | HUMTEN_PEA_1_T7 (SEQ ID NO: 860) |
| HUMTEN_PEA_1_P10 | 938 | HUMTEN_PEA_1_T11 (SEQ ID NO: 861) |
| HUMTEN_PEA_1_P11 | 939 | HUMTEN_PEA_1_T14 (SEQ ID NO: 862) |
| HUMTEN_PEA_1_P13 | 940 | HUMTEN_PEA_1_T16 (SEQ ID NO: 863) |
| HUMTEN_PEA_1_P14 | 941 | HUMTEN_PEA_1_T17 (SEQ ID NO: 864) |
| HUMTEN_PEA_1_P15 | 942 | HUMTEN_PEA_1_T18 (SEQ ID NO: 865) |
| HUMTEN_PEA_1_P16 | 943 | HUMTEN_PEA_1_T19 (SEQ ID NO: 866) |
| HUMTEN_PEA_1_P17 | 944 | HUMTEN_PEA_1_T20 (SEQ ID NO. 867) |
| HUMTEN_PEA_1_P20 | 945 | HUMTEN_PEA_1_T23 (SEQ ID NO: 868) |
| HUMTEN_PEA_1_P26 | 946 | HUMTEN_PEA_1_T32 (SEQ ID NO: 869) |
| HUMTEN_PEA_1_P27 | 947 | HUMTEN_PEA_1_T35 (SEQ ID NO: 870) |

TABLE 3-continued

Proteins of interest

| Protein Name | SEQ ID NO: | Corresponding Transcript(s) |
|---|---|---|
| HUMTEN_PEA_1_P28 | 948 | HUMTEN_PEA_1_T36 (SEQ ID NO: 871) |
| HUMTEN_PEA_1_P29 | 949 | HUMTEN_PEA_1_T37 (SEQ ID NO: 872) |
| HUMTEN_PEA_1_P30 | 950 | HUMTEN_PEA_1_T39 (SEQ ID NO: 873) |
| HUMTEN_PEA_1_P31 | 951 | HUMTEN_PEA_1_T40 (SEQ ID NO: 874) |
| HUMTEN_PEA_1_P32 | 952 | HUMTEN_PEA_1_T41 (SEQ ID NO: 875) |

These sequences are variants of the known protein Tenascin precursor (SwissProt accession identifier TENA_HUMAN; known also according to the synonyms TN; Hexabrachion; Cytotactin; Neuronectin; GMEM; JI; Miotendinous antigen; Glioma-associated-extracellular matrix antigen; GP 150-225; Tenascin-C; TN-C), SEQ ID NO: 933, referred to herein as the previously known protein.

Protein Tenascin precursor is known or believed to have the following function(s): SAM (substrate-adhesion molecule) that appears to inhibit cell migration. May play a role in supporting the growth of epithelial tumors. Is a ligand for integrins alpha-8/beta-1, alpha-9/beta-1, alpha-v/beta-3 and alpha-v/beta-6. The sequence for protein Tenascin precursor is given at the end of the application, as "Tenascin precursor amino acid sequence". Known polymorphisms for this sequence are as shown in Table 4.

TABLE 4

Amino acid mutations for Known Protein

| SNP position(s) on amino acid sequence | Comment |
|---|---|
| 2008 | Q -> E (in dbSNP:13321)./FTId = VAR_014665. |
| 244 | Missing |
| 370 | L -> V |
| 539 | Q -> R |
| 680 | Q -> R |
| 1066 | R -> H |
| 1600-1608 | SGFTQGHQT -> LWLHPRASN |
| 1677 | L -> I |
| 2054 | F -> FLH |
| 2055 | W -> L |
| 2140-2143 | YKGA -> TRG |

Protein Tenascin precursor localization is believed to be secreted; extracellular matrix.

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: DNA antagonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer; antibody.

The following GO Annotation(s) apply to the previously known protein. The following annotation(s) were found: cell adhesion, which are annotation(s) related to Biological Process; cell adhesion receptor; ligand binding or carrier; protein binding, which are annotation(s) related to Molecular Function; and extracellular matrix, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster HUMTEN can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 37 refer to weighted expression of ESTs in each category, as "parts per million" (ratio of the expression of ESTs for a particular cluster to the expression of all ESTs in that category, according to parts per million).

Figure 37:
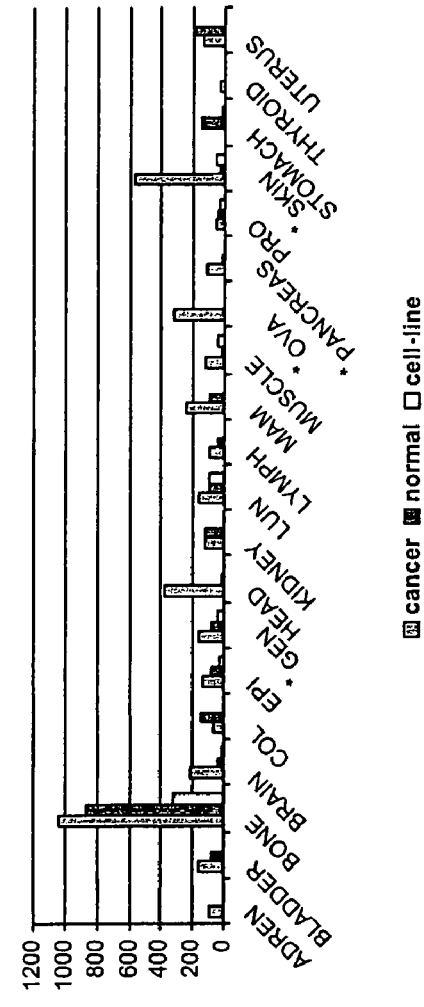
FIG. 37 shows cancer and cell-line vs. normal tissue expression.

Overall, the following results were obtained as shown with regard to the histograms in FIG. 37 and Table 5. This cluster is overexpressed (at least at a minimum level) in the following pathological conditions: a mixture of malignant tumors from different tissues, ovarian carcinoma, pancreas carcinoma and skin malignancies.

TABLE 5

Normal tissue distribution

| Name of Tissue | Number |
|---|---|
| adrenal | 0 |
| bladder | 82 |
| bone | 867 |
| brain | 41 |
| colon | 154 |
| epithelial | 87 |
| general | 83 |
| head and neck | 20 |
| kidney | 123 |
| lung | 97 |
| lymph nodes | 37 |
| breast | 96 |
| muscle | 7 |
| ovary | 0 |
| pancreas | 10 |
| prostate | 38 |
| skin | 32 |
| stomach | 146 |
| Thyroid | 0 |
| uterus | 195 |

TABLE 6

P values and ratios for expression in cancerous tissue

| Name of Tissue | P1 | P2 | SP1 | R3 | SP2 | R4 |
|---|---|---|---|---|---|---|
| adrenal | 4.2e−01 | 4.6e−01 | 2.1e−01 | 3.4 | 2.9e−01 | 2.7 |
| bladder | 2.8e−01 | 4.2e−01 | 3.5e−01 | 1.6 | 6.0e−01 | 1.1 |
| bone | 4.7e−01 | 7.4e−01 | 3.2e−01 | 0.3 | 9.8e−01 | 0.4 |
| brain | 5.5e−02 | 8.0e−02 | 1.7e−06 | 2.3 | 5.1e−04 | 1.5 |
| colon | 6.5e−01 | 7.6e−01 | 9.4e−01 | 0.5 | 9.8e−01 | 0.4 |
| epithelial | 2.4e−02 | 4.2e−01 | 4.2e−03 | 1.3 | 7.5e−01 | 0.8 |
| general | 8.7e−05 | 3.2e−02 | 1.8e−09 | 1.7 | 2.1e−02 | 1.1 |
| head and neck | 2.3e−01 | 4.0e−01 | 9.9e−02 | 3.5 | 4.2e−01 | 1.6 |
| kidney | 7.0e−01 | 8.2e−01 | 6.2e−01 | 1.0 | 8.8e−01 | 0.6 |
| lung | 5.1e−01 | 6.5e−01 | 1.5e−01 | 1.5 | 3.2e−01 | 1.1 |
| lymph nodes | 3.3e−01 | 7.6e−01 | 3.2e−01 | 2.0 | 7.9e−01 | 0.8 |
| breast | 1.0e−01 | 2.3e−01 | 1.4e−01 | 1.6 | 5.3e−01 | 1.0 |
| muscle | 4.0e−02 | 1.7e−02 | 1.5e−01 | 5.6 | 1.5e−01 | 3.2 |
| ovary | 1.4e−01 | 1.7e−01 | 7.0e−04 | 3.4 | 6.4e−03 | 2.6 |
| pancreas | 7.5e−02 | 2.0e−01 | 5.8e−03 | 5.3 | 2.8e−02 | 3.6 |

TABLE 6-continued

P values and ratios for expression in cancerous tissue

| Name of Tissue | P1 | P2 | SP1 | R3 | SP2 | R4 |
|---|---|---|---|---|---|---|
| prostate | 8.4e−01 | 8.6e−01 | 3.6e−01 | 1.2 | 4.4e−01 | 1.1 |
| skin | 2.8e−01 | 1.7e−01 | 3.2e−05 | 5.6 | 5.5e−02 | 1.8 |
| stomach | 5.8e−01 | 7.5e−01 | 1 | 0.2 | 1 | 0.3 |
| Thyroid | 3.6e−01 | 3.6e−01 | 1 | 1.2 | 1 | 1.2 |
| uterus | 2.9e−01 | 7.4e−01 | 8.0e−01 | 0.6 | 9.9e−01 | 0.4 |

As noted above, cluster HUMTEN features 19 transcript(s), which were listed in Table 1 above. These transcript(s) encode for protein(s) which are variant(s) of protein Tenascin precursor. A description of each variant protein according to the present invention is now provided.

Variant protein HUMTEN_PEA_1_P5 (SEQ ID NO: 934) according to the present invention has an amino acid sequence as given at the end of the application; it is encoded by transcript(s) HUMTEN_PEA_1_T4 (SEQ ID NO: 857). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P5 (SEQ ID NO: 934) and TENA_HUMAN_V1:

1. An isolated chimeric polypeptide encoding for HUMTEN_PEA_1_P5 (SEQ ID NO: 934), comprising a first amino acid sequence being at least 90% homologous to MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDC SDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQ CICHEGFTGLDCGQHSCPSDCNNLGQCVSGRCICNEGYSGEDCSEVSPPKDLVVTEVTE ETVNLAWDNEMRVTEYLVVYTPTHEGGLEMQFRVPGDQTSTIIQELEPGVEYFIRVFAI LENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPT-GQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLG EVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYD QFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMA TDGIFETFTIEIIDSNRLLETVEYNISGAERTAHISGLPPSTDFIVYLSGLAPSIRTKTISATA T corresponding to amino acids 1-1525 of TENA_HUMAN_V1, which also corresponds to amino acids 1-1525 of HUMTEN_PEA_1_P5 (SEQ ID NO: 934), a second amino acid sequence being at least 70%, optionally at least 80%, preferably at least 85%, more preferably at least 90% and most preferably at least 95% homologous to a polypeptide having the sequence TEPKPQLGTLIFSNITPKSFNMSWTTQAGLFAKIVINVSDAHSLHESQQFTVSGDAKQAH ITGLVENTGYDVSVAGTTLAGDPTRPLTAFVI (SEQ ID NO: 1144) corresponding to amino acids 1526-1617 of HUMTEN_PEA_1_P5 (SEQ ID NO: 934), and a third amino acid sequence being at least 90% homologous to TEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTR LVKLIPGVEYLVSIIAMKGFEESEPVSGSFTTALDGPSGLVTANITDSEALARWQPA IATV DSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGGQYELRVDLRDHGETAFAVYDKFSVGDAKTRYKLKVEGYSGTAGDSMAYHN GRSFSTFDKDTDSAITNCALSYKGAFWYRNCHRVNLMGRYGDNNHSQGVNWFHWKGHEHSIQFAEMKLRPSNFRNLEGRRKRA corresponding to amino acids 1526-2201 of TENA_HUMAN_V1, which also corresponds to amino acids 1618-2293 of HUMTEN_PEA_1_P5 (SEQ ID NO: 934), wherein said first amino acid sequence, second amino acid sequence and third amino acid sequence are contiguous and in a sequential order.

2. An isolated polypeptide encoding for an edge portion of HUMTEN_PEA_1_P5 (SEQ ID NO: 934), comprising an amino acid sequence being at least 70%, optionally at least about 80%, preferably at least about 85%, more preferably at least about 90% and most preferably at least about 95% homologous to the sequence encoding for TEPKPQLGTLIFSNITPKSFNMSWTTQAGLFAKIVINVSDAHSLHESQQFTVSGDAKQAH ITGLVENTGYDVSVAGTTLAGDPTRPLTAFVI (SEQ ID NO: 1144), corresponding to HUMTEN_PEA_1_P5 (SEQ ID NO: 934).

It should be noted that the known protein sequence (TENA_HUMAN; SEQ ID NO:933) has one or more changes than the sequence given at the end of the application and named as being the amino acid sequence for TENA_HUMAN_V1 (SEQ ID NO:934). These changes were previously known to occur and are listed in the table below.

TABLE 7

Changes to TENA_HUMAN_V1

| SNP position(s) on amino acid sequence | Type of change |
|---|---|
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMTEN_PEA_1_P5 (SEQ ID NO: 934) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein HUMTEN_PEA_1_P5 (SEQ ID NO: 934) sequence provides support for the deduced sequence of this variant protein according to the present invention).

TABLE 8

Amino acid mutations

| SNP position(s) on amino acid sequence | Alternative amino acid(s) | Previously known SNP? |
|---|---|---|
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 1066 | R -> H | No |
| 1534 | T -> M | Yes |
| 1769 | L -> I | Yes |
| 1873 | A -> T | Yes |
| 2100 | Q -> E | Yes |
| 2122 | K -> | No |
| 2130 | Q -> | No |
| 2159 | Q -> | No |
| 2265 | K -> | No |
| 2291 | K -> | No |
| 2291 | K -> Q | No |

Variant protein HUMTEN_PEA_1_P5 (SEQ ID NO: 934) is encoded by the following transcript(s): HUMTEN_PEA_1_T4 (SEQ ID NO: 857), for which the sequence(s) is/are given at the end of the application. The coding portion of transcript HUMTEN_PEA_1_T4 (SEQ ID NO: 857) is shown in bold; this coding portion starts at position 348 and ends at position 7226. The transcript also has the following SNPs as listed in Table 9 (given according to their position on the nucleotide sequence, with the alternative nucleic acid listed; the last column indicates whether the SNP is known or not; the presence of known SNPs in variant protein HUMTEN_PEA_1_P5 (SEQ ID NO: 934) sequence provides support for the deduced sequence of this variant protein according to the present invention).

TABLE 9

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |
| 3512 | C -> T | Yes |
| 3544 | G -> A | No |
| 3635 | A -> G | Yes |
| 4922 | G -> A | No |
| 4948 | C -> T | Yes |
| 5652 | T -> A | Yes |
| 5825 | A -> G | Yes |
| 5964 | G -> A | Yes |
| 6296 | A -> G | Yes |
| 6368 | C -> A | Yes |
| 6645 | C -> G | Yes |
| 6712 | A -> | No |
| 6736 | A -> | No |
| 6824 | G -> | No |
| 6872 | C -> T | Yes |
| 7142 | G -> | No |
| 7218 | A -> | No |
| 7218 | A -> C | No |
| 7233 | C -> G | Yes |
| 7234 | C -> G | Yes |
| 7236 | G -> | No |
| 7344 | G -> A | Yes |
| 7424 | A -> G | No |
| 7632 | A -> C | No |
| 7638 | T -> C | No |
| 7659 | -> T | No |
| 7828 | -> T | No |
| 7839 | A -> C | No |
| 8183 | G -> C | Yes |
| 8745 | G -> T | Yes |

Variant protein HUMTEN_PEA_1_P6 (SEQ ID NO: 935) according to the present invention has an amino acid sequence as given at the end of the application; it is encoded by transcript(s) HUMTEN_PEA_1_T5 (SEQ ID NO: 858) HUMTEN_PEA_1_T5 (SEQ ID NO: 858) (SEQ ID NO: 859). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P6 (SEQ ID NO: 935) and TENA_HUMAN_V1:

1. An isolated chimeric polypeptide encoding for HUMTEN_PEA_1_P6 (SEQ ID NO: 935), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTRLDAPSQIEVKDVT DTTALITWFKPLAEIDGIELTYGIKD-VPGDRTTIDLTEDENQYSIGNLKPDTEYEVSLISRR GDMSSNPAKETFTTGLDAPRNLR-RVSQTDNSITLEWRNGKAAIDSYRIKYAPISGGDHA EVDVPKSQQATTKTTLTGLRPGTEY-GIGVSAVKEDKESNPATINAATELDTPKDLQVSE TAETSLTLLWKTPLAKFDRYRLNYSLPT-GQWVGVQLPRNTTSYVLRGLEPGQEYNVLL TAEKGRHKSKPARVKASTEQAPELEN-LTVTEVGWDGLRLNWTAADQAYEHFIIQVQE ANKVEAARNLTVPGSLRAVDIPGLKAAT-PYTVSIYGVIQGYRTPVLSAEASTGETPNLG EVV-VAEVGWDALKLNWTAPEGAYEY-FFIQVQEADTVEAAQNLTVPGGLRSTDLPGLK AATHYTITIRGVTQDFSTTPLSVEVL-TEEVPDMGNLTVTEVSWDALRLNWTTPDGTYD QFT-IQVQEADQVEEAHNLTVPGSLRS-MEIPGLRAGTPYTVTLHGEVRGHSTRPLAVEVV TEDLPQLGDLAVSEVGWDGLRLNWTAAD-NAYEHFVIQVQEVNKVEAAQNLTLPGSLR AVDIPGLEAATPYRVSIYGVIRGYRTPV-LSAEASTAKEPEIGNLNVSDITPESFNLSWMA TDG-IFETFTIEIIDSNRLLETVEYNISGAER-TAHISGLPPSTDFIVYLSGLAPSIRTKTISATA TTE corresponding to amino acids 1-1527 of TENA_HU-MAN_V1, which also corresponds to amino acids 1-1527 of HUMTEN_PEA_1_P6 (SEQ ID NO: 935), and a second amino acid sequence being at least 70%, optionally at least 80%, preferably at least 85%, more preferably at least 90% and most preferably at least 95% homologous to a polypeptide having the sequence PKPQLGTLIFSNITPKSFNM-SWTTQAGLFAKIVINVSDAHSL-HESQQFTVSGDAKQAHIT GLVENTGYDVSVAGTTLAGDPTRPL-TAFVITGTQSEVLTCLTQREKEISHLKGKFNKNTI FTANVYSLIFN (SEQ ID NO: 1098) corresponding to amino acids 1528-1658 of HUMTEN_PEA_1_P6 (SEQ ID NO: 935), wherein said first amino acid sequence and second amino acid sequence are contiguous and in a sequential order.

2. An isolated polypeptide encoding for a tail of HUMTEN_PEA_1_P6 (SEQ ID NO: 935), comprising a polypeptide being at least 70%, optionally at least about 80%, preferably at least about 85%, more preferably at least about 90% and most preferably at least about 95% homologous to the sequence PKPQLGTLIFSNITPKSFNMSWTTQA-GLFAKIVINVSDAHSLHESQQFTVSGDAKQAHIT GLVENTGYDVSVAGTTLAGDPTRPL-TAFVITGTQSEVLTCLTQREKEISHLKGKFNKNTI FTANVYSLIFN (SEQ ID NO: 1098) in HUMTEN_PEA_1_P6 (SEQ ID NO: 935).

It should be noted that the known protein sequence (TEN-A_HUMAN) has one or more changes than the sequence given at the end of the application and named as being the amino acid sequence for TENA_HUMAN_V1. These changes were previously known to occur and are listed in the table below.

TABLE 10

| Changes to TENA_HUMAN_V1 | |
| --- | --- |
| SNP position(s) on amino acid sequence | Type of change |
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMTEN_PEA_1_P6 (SEQ ID NO: 935) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein HUMTEN_PEA_1_P6 (SEQ ID NO: 935) sequence provides support for the deduced sequence of this variant protein according to the present invention).

TABLE 11

| Amino acid mutations | | |
| --- | --- | --- |
| SNP position(s) on amino acid sequence | Alternative amino acid(s) | Previously known SNP? |
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 1066 | R -> H | No |
| 1534 | T -> M | Yes |

Variant protein HUMTEN_PEA_1_P6 (SEQ ID NO: 935) is encoded by the following transcript(s): HUMTEN_PEA_1_T5 (SEQ ID NO: 858) HUMTEN_PEA_1_T5 (SEQ ID NO: 858) (SEQ ID NO: 859), for which the sequence(s) is/are given at the end of the application. The coding portion of transcript HUMTEN_PEA_1_T5 (SEQ ID NO: 858) HUMTEN_PEA_1_T5 (SEQ ID NO: 858) (SEQ ID NO: 859) is shown in bold; this coding portion starts at position 348 and ends at position 5321. The transcript also has the following SNPs as listed in Table 12 (given according to their position on the nucleotide sequence, with the alternative nucleic acid listed; the last column indicates whether the SNP is known or not; the presence of known SNPs in variant protein HUMTEN_PEA_1_P6 (SEQ ID NO: 935) sequence provides support for the deduced sequence of this variant protein according to the present invention).

TABLE 12

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |
| 3512 | C -> T | Yes |
| 3544 | G -> A | No |
| 3635 | A -> G | Yes |
| 4922 | G -> A | No |
| 4948 | C -> T | Yes |
| 5210 | A -> G | Yes |
| 6231 | G -> A | Yes |
| 6247 | A -> C | Yes |
| 6354 | T -> C | Yes |
| 6391 | A -> | Yes |
| 6394 | A -> | Yes |
| 6630 | C -> A | Yes |
| 6766 | G -> A | Yes |
| 6857 | C -> T | Yes |
| 6886 | C -> T | Yes |
| 7330 | G -> T | Yes |
| 7430 | T -> C | Yes |
| 7444 | A -> G | Yes |
| 7690 | A -> G | No |
| 7821 | C -> T | Yes |
| 7876 | T -> C | Yes |
| 8109 | T -> A | Yes |
| 8424 | G -> A | Yes |
| 8776 | T -> C | No |
| 8861 | A -> | No |
| 8906 | G -> C | Yes |
| 9016 | A -> G | Yes |
| 9859 | T -> A | Yes |
| 10032 | A -> G | Yes |
| 10171 | G -> A | Yes |
| 10503 | A -> G | Yes |
| 10575 | C -> A | Yes |
| 10852 | C -> G | Yes |
| 10919 | A -> | No |
| 10943 | A -> | No |
| 11031 | G -> | No |

TABLE 12-continued

Nucleic acid SNPs

| SNP position on nucleotide sequence | Alternative nucleic acid | Previously known SNP? |
|---|---|---|
| 11079 | C -> T | Yes |
| 11349 | G -> | No |
| 11425 | A -> | No |
| 11425 | A -> C | No |
| 11440 | C -> G | Yes |
| 11441 | C -> G | Yes |
| 11443 | G -> | No |
| 11551 | G -> A | Yes |
| 11631 | A -> G | No |
| 11839 | A -> C | No |
| 11845 | T -> C | No |
| 11866 | -> T | No |
| 12035 | -> T | No |
| 12046 | A -> C | No |
| 12390 | G -> C | Yes |
| 12952 | G -> T | Yes |

Variant protein HUMTEN_PEA_1_P7 (SEQ ID NO: 936) according to the present invention has an amino acid sequence as given at the end of the application; it is encoded by transcript(s) HUMTEN_PEA_1_T6 (SEQ ID NO: 859). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P7 (SEQ ID NO: 936) and TENA_HUMAN_V1:

1. An isolated chimeric polypeptide encoding for HUMTEN_PEA_1_P7 (SEQ ID NO: 936), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTRLDAPSQIEVKDVT DTTALITWFKPLAEIDGIELTYGIKD-VPGDRTTIDLTEDENQYSIGNLKPDTEYEVSLISRR GDMSSNPAKETFTTGLDAPRNLR- RVSQTDNSITLEWRNGKAAIDSYRIKYAPISGGDHA EVDVPKSQQATTKTTLTGLRPGTEY-GIGVSAVKEDKESNPATINAATELDTPKDLQVSE TAETSLTLLWKTPLAKFDRYRLNYSLPT-GQWVGVQLPRNTTSYVLRGLEPGQEYNVLL TAEKGRHKSKPARVKASTEQAPELEN-LTVTEVGWDGLRLNWTAADQAYEHFIIQVQE ANKVEAARNLTVPGSLRAVDIPGLKAAT-PYTVSIYGVIQGYRTPVLSAEASTGETPNLG EVV-VAEVGWDALKLNWTAPEGAYEY-FFIQVQEADTVEAAQNLTVPGGLRSTDLPGLK AATHYTITIRGVTQDFSTTPLSVEVL-TEEVPDMGNLTVTEVSWDALRLNWTTPDGTYD QFT-IQVQEADQVEEAHNLTVPGSLRS-MEIPGLRAGTPYTVTLHGEVRGHSTRPLAVEVV TEDLPQLGDLAVSEVGWDGLRLNWTAAD-NAYEHFVIQVQEVNKVEAAQNLTLPGSLR AVDIPGLEAATPYRVSIYGVIRGYRTPV-LSAEASTAKEPEIGNLNVSDITPESFNLSWMA TDG-IFETFTIEIIDSNRLLETVEYNISGAER-TAHISGLPPSTDFIVYLSGLAPSIRTKTISATA TTEALPLLENLTISDINPYGFTVSW-MASENAFDSFLVTVVDSGKLLDPQEFTLSGTQRKL ELRGLITGIGYEVMVSGFTQGHQTKPLRAEIVT corresponding to amino acids 1-1617 of TENA_HUMAN_V1, which also corresponds to amino acids 1-1617 of HUMTEN_PEA_1_P7 (SEQ ID NO: 936), and a second amino acid sequence being at least 70%, optionally at least 80%, preferably at least 85%, more preferably at least 90% and most preferably at least 95% homologous to a polypeptide having the sequence GISNQVSHLFLFLVPFCVICLPDRHD-FNIFVHIPYLIHKCSLLFHLLPTLPLVICT (SEQ ID NO: 1099) corresponding to amino acids 1618-1673 of HUMTEN_PEA_1_P7 (SEQ ID NO: 936), wherein said first amino acid sequence and second amino acid sequence are contiguous and in a sequential order.

2. An isolated polypeptide encoding for a tail of HUMTEN_PEA_1_P7 (SEQ ID NO: 936), comprising a polypeptide being at least 70%, optionally at least about 80%, preferably at least about 85%, more preferably at least about 90% and most preferably at least about 95% homologous to the sequence GISNQVSHLFLFLVPFCVICLPDRHD-FNIFVHIPYLIHKCSLLFHLLPTLPLVICT (SEQ ID NO: 1099) in HUMTEN_PEA_1_P7 (SEQ ID NO: 936).

It should be noted that the known protein sequence (TEN-A_HUMAN) has one or more changes than the sequence given at the end of the application and named as being the amino acid sequence for TENA_HUMAN_V1. These changes were previously known to occur and are listed in the table below.

TABLE 13

Changes to TENA_HUMAN_V1

| SNP position(s) on amino acid sequence | Type of change |
|---|---|
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTEN_PEA_1_P7 (SEQ ID NO: 936) also has the following non-silent SNPs (Single Nucleotide Polymorphisms) as listed in Table 14, (given according to their position(s) on the amino acid sequence, with the alternative amino acid(s) listed; the last column indicates whether the SNP is known or not; the presence of known SNPs in variant protein HUMTEN_PEA_1_P7 (SEQ ID NO: 936) sequence provides support for the deduced sequence of this variant protein according to the present invention).

TABLE 14

Amino acid mutations

| SNP position(s) on amino acid sequence | Alternative amino acid(s) | Previously known SNP? |
|---|---|---|
| 149 | T -> G | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 1066 | R -> H | No |

Variant protein HUMTEN_PEA_1_P7 (SEQ ID NO: 936) is encoded by the following transcript(s): HUMTEN_PEA_1_T6 (SEQ ID NO: 859), for which the sequence(s) is/are given at the end of the application. The coding portion of transcript HUMTEN_PEA_1_T6 (SEQ ID NO: 859) is shown in bold; this coding portion starts at position 348 and ends at position 5366. The transcript also has the following SNPs as listed in Table 15 (given according to their position on the nucleotide sequence, with the alternative nucleic acid listed; the last column indicates whether the SNP is known or not; the presence of known SNPs in variant protein HUMTEN_PEA_1_P7 (SEQ ID NO: 936) sequence provides support for the deduced sequence of this variant protein according to the present invention).

TABLE 15

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |

TABLE 15-continued

Nucleic acid SNPs

| SNP position on nucleotide sequence | Alternative nucleic acid | Previously known SNP? |
|---|---|---|
| 3512 | C -> T | Yes |
| 3544 | G -> A | No |
| 3635 | A -> G | Yes |
| 4922 | G -> A | No |
| 5488 | C -> A | Yes |
| 5497 | T -> A | No |
| 5580 | C -> T | Yes |
| 5681 | A -> G | No |
| 5702 | G -> A | Yes |
| 6202 | A -> | Yes |
| 6953 | T -> A | Yes |
| 7126 | A -> G | Yes |
| 7265 | G -> A | Yes |
| 7597 | A -> G | Yes |
| 7669 | C -> A | Yes |
| 7946 | C -> G | Yes |
| 8013 | A -> | No |
| 8037 | A -> | No |
| 8125 | G -> | No |
| 8173 | C -> T | Yes |
| 8443 | G -> | No |
| 8519 | A -> | No |
| 8519 | A -> C | No |
| 8534 | C -> G | Yes |
| 8535 | C -> G | Yes |
| 8537 | G -> | No |
| 8645 | G -> A | Yes |
| 8725 | A -> G | No |
| 8933 | A -> C | No |
| 8939 | T -> C | No |
| 8960 | -> T | No |
| 9129 | -> T | No |
| 9140 | A -> C | No |
| 9484 | C -> C | Yes |
| 10046 | G -> T | Yes |

Variant protein HUMTEN_PEA_1_P8 (SEQ ID NO: 937) according to the present invention has an amino acid sequence as given at the end of the application; it is encoded by transcript(s) HUMTEN_PEA_1_T7 (SEQ ID NO: 860). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P8 (SEQ ID NO: 937) and TENA_HUMAN_V1:

1. An isolated chimeric polypeptide encoding for HUMTEN_PEA_1_P8 (SEQ ID NO: 937), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTRLDAPSQIEVKDVT DTTALITWFKPLAEIDGIELTYGIKD-VPGDRTTIDLTEDENQYSIGNLKPDTEYEVSLISRR GDMSSNPAKETFTTGLDAPRNLR-RVSQTDNSITLEWRNGKAAIDSYRIKYAPISGGDHA EVDVPKSQQATTKTTLTGLRPGTEY-GIGVSAVKEDKESNPATINAATELDTPKDLQVSE TAETSLTLLWKTPLAKFDRYRLNYSLPT-GQWVGVQLPRNTTSYVLRGLEPGQEYNVLL TAEKGRHKSKPARVKASTEQAPELEN-LTVTEVGWDGLRLNWTAADQAYEHFIIQVQE ANKVEAARNLTVPGSLRAVDIPGLKAAT-PYTVSIYGVIQGYRTPVLSAEASTGETPNLG EVV-VAEVGWDALKLNWTAPEGAYEY-FFIQVQEADTVEAAQNLTVPGGLRSTDLPGLK AATHYTITIRGVTQDFSTTPLSVEVL-TEEVPDMGNLTVTEVSWDALRLNWTTPDGTYD QFT-IQVQEADQVEEAHNLTVPGSLRS-MEIPGLRAGTPYTVTLHGEVRGHSTRPLAVEVV TEDLPQLGDLAVSEVGWDGLRLNWTAAD-NAYEHFVIQVQEVNKVEAAQNLTLPGSLR AVDIPGLEAATPYRVSIYGVIRGYRTPV-LSAEASTAKEPEIGNLNVSDITPESFNLSWMA TDG-IFETFTIEIIDSNRLLETVEYNISGAER-TAHISGLPPSTDFIVYLSGLAPSIRTKTISATA T corresponding to amino acids 1-1525 of TENA_HUMAN_V1, which also corresponds to amino acids 1-1525 of HUMTEN_PEA_1_P8 (SEQ ID NO: 937), and a second amino acid sequence being at least 90% homologous to TEAEPEVDNLLVSDATPDGFRLSWTADE-GVFDNFVLKIRDTKKQSEPLEITLLAPERTRD LTGL-REATEYEIELYGISKGRRSQTVSAIAT-TAMGSPKEVIFSDITENSATVSWRAPTAQV ESFRITYVPITGGTPSMVTVDGTKTQTR-LVKLIPGVEYLVSIIAMKGFEESEPVSGSFTTA LDGPS-GLVTANITDSEALARWQPAIATVDSYVI-SYTGEKVPEITRTVSGNTVEYALTDLE PATEYTLRIFAEKGPQKSSTITAK-FTTDLDSPRDLTATEVQSETALLTWRPPRASVTGYL LVYESVDGTVKEVIVGPDTTSYSLADL-SPSTHYTAKIQALNGPLRSNMIQTIFTTIGLLYP FPKDCSQAMLNGDTTSGLYTIYLNGD-KAQALEVFCDMTSDGGGWIVFLRRKNGRENF YQN-WKAYAAGFGDRREEFWLGLDNLNKI-TAQGQYELRVDLRDHGETAFAVYDKFSV GDAKTRYKLKVEGYSGTAGDSMAYH-NGRSFSTFDKDTDSAITNCALSYKGAFWYRNC HRVNLMGRYGDNNHSQGVNWFHWKGHEH-SIQFAEMKLRPSNFRNLEGRRKRA corresponding to amino acids 1617-2201 of TENA_HUMAN_V1, which also corresponds to amino acids 1526-2110 of HUMTEN_PEA_1_P8 (SEQ ID NO: 937), wherein said first amino acid sequence and second amino acid sequence are contiguous and in a sequential order.

2. An isolated chimeric polypeptide encoding for an edge portion of HUMTEN_PEA_1_P8 (SEQ ID NO: 937), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TT, having a structure as follows: a sequence starting from any of amino acid numbers 1525-x to 1525; and ending at any of amino acid numbers 1526+((n−2)−x), in which x varies from 0 to n−2.

It should be noted that the known protein sequence (TENA_HUMAN) has one or more changes than the sequence given at the end of the application and named as being the amino acid sequence for TENA_HUMAN_V1. These changes were previously known to occur and are listed in the table below.

TABLE 16

Changes to TENA_HUMAN_V1

| SNP position(s) on amino acid sequence | Type of change |
|---|---|
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMTEN_PEA_1_P8 (SEQ ID NO: 937) also has the following non-silent SNPs (Single Nucleotide Polymorphisms) as listed in Table 17, (given according to their position(s) on the amino acid sequence, with the alternative amino acid(s) listed; the last column indicates whether the SNP is known or not; the presence of known SNPs in variant protein HUMTEN_PEA_1_P8 (SEQ ID NO: 937) sequence provides support for the deduced sequence of this variant protein according to the present invention).

TABLE 17

Amino acid mutations

| SNP position(s) on amino acid sequence | Alternative amino acid(s) | Previously known SNP? |
|---|---|---|
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 1066 | R -> H | No |
| 1586 | L -> I | Yes |
| 1690 | A -> T | Yes |
| 1917 | Q -> E | Yes |
| 1939 | K -> | No |
| 1947 | Q -> | No |
| 1976 | Q -> | No |
| 2082 | K -> | No |

TABLE 17-continued

Amino acid mutations

| SNP position(s) on amino acid sequence | Alternative amino acid(s) | Previously known SNP? |
|---|---|---|
| 2108 | K -> | No |
| 2108 | K -> Q | No |

Variant protein HUMTEN_PEA_1_P8 (SEQ ID NO: 937) is encoded by the following transcript(s): HUMTEN_PEA_1_T7 (SEQ ID NO: 860), for which the sequence(s) is/are given at the end of the application. The coding portion of transcript HUMTEN_PEA_1_T7 (SEQ ID NO: 860) is shown in bold; this coding portion starts at position 348 and ends at position 6677. The transcript also has the following SNPs as listed in Table 18 (given according to their position on the nucleotide sequence, with the alternative nucleic acid listed; the last column indicates whether the SNP is known or not; the presence of known SNPs in variant protein HUMTEN_PEA_1_P8 (SEQ ID NO: 937) sequence provides support for the deduced sequence of this variant protein according to the present invention).

TABLE 18

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |
| 3512 | C -> T | Yes |
| 3544 | G -> A | No |
| 3635 | A -> G | Yes |
| 4922 | G -> A | No |
| 5103 | T -> A | Yes |
| 5276 | A -> G | Yes |
| 5415 | G -> A | Yes |
| 5747 | A -> G | Yes |
| 5819 | C -> A | Yes |
| 6096 | C -> G | Yes |
| 6163 | A -> | No |
| 6187 | A -> | No |
| 6275 | G -> | No |
| 6323 | C -> T | Yes |
| 6593 | G -> | No |
| 6669 | A -> | No |
| 6669 | A -> C | No |
| 6684 | C -> C | Yes |
| 6685 | C -> G | Yes |
| 6687 | G -> | No |
| 6795 | G -> A | Yes |
| 6875 | A -> G | No |
| 7083 | A -> C | No |

TABLE 18-continued

Nucleic acid SNPs

| SNP position on nucleotide sequence | Alternative nucleic acid | Previously known SNP? |
|---|---|---|
| 7089 | T -> C | No |
| 7110 | -> T | No |
| 7279 | -> T | No |
| 7290 | A -> C | No |
| 7634 | G -> C | Yes |
| 8196 | G -> T | Yes |

Variant protein HUMTEN_PEA_1_P10 (SEQ ID NO: 938) according to the present invention has an amino acid sequence as given at the end of the application; it is encoded by transcript(s) HUMTEN_PEA_1_T11 (SEQ ID NO: 861). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P10 (SEQ ID NO: 938) and TENA_HUMAN_V1:

1. An isolated chimeric polypeptide encoding for HUMTEN_PEA_1_P10 (SEQ ID NO: 938), comprising a first amino acid sequence being at least 90% homologous to MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDC SDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQ CICHEGFTGLDCGQHSCPSDCNNLGQCVSGRCICNEGYSGEDCSEVSPPKDLVVTE VTE ETVNLAWDNEMRVTEYLVVYTPTHEGGLEMQFRVPGDQTSTIIQELEPGVEYFIRVFAI LENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLG EVVVAEVGWDALKLNWTAPEGAYEYFFIQVQEADTVEAAQNLTVPGGLRSTDLPGLKAATHYTITIRGVTQDFSTTPLSVEVL corresponding to amino acids 1-1252 of TENA_HUMAN_V1, which also corresponds to amino acids 1-1252 of HUMTEN_PEA_1_P10 (SEQ ID NO: 938), and a second amino acid sequence being at least 90% homologous to TEDLPQLGDLAVSEVGWDGLRLNWTAADNAYEHFVIQVQEVNKVEAAQNLTLPGSLR AVDIPGLEAATPYRVSIYGVIRGYRTPVLSAEASTAKEPEIGNLNVSDITPESFNLSWMA TDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDLTGLREATEYEIELYGISKGRRSQTVSA IATTAMGSPKEVIFSDITENSATVSWRAPTAQVESFRITYVPITGGTPSMVTVDGTK TQT RLVKLIPGVEYLVSIIAMKGFEESEPVSGSFTTALDGPSGLVTANITDSEALARWQPAIAT VDSYVISYTGEKVPEITRTVSGNTVEYALTDLEPATEYTLRIFAEKGPQKSSTITAKFT TD LDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNL NKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWK GHEHSIQFAEMKLRPSNFRNLEGRRKRA corresponding to amino acids 1344-2201 of TENA_HUMAN_V1, which also corresponds to amino acids 1253-2110 of HUMTEN_PEA_1_P10 (SEQ ID NO: 938), wherein said first amino acid sequence and second amino acid sequence are contiguous and in a sequential order.

2. An isolated chimeric polypeptide encoding for an edge portion of HUMTEN_PEA_1_P10 (SEQ ID NO: 938), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LT, having a structure as follows: a sequence starting from any of amino acid numbers 1252–x to 1252; and ending at any of amino acid numbers 1253+((n−2)−x), in which x varies from 0 to n−2.

It should be noted that the known protein sequence (TENA_HUMAN) has one or more changes than the sequence given at the end of the application and named as being the amino acid sequence for TENA_HUMAN_V1. These changes were previously known to occur and are listed in the table below.

TABLE 19

Changes to TENA_HUMAN_V1

| SNP position(s) on amino acid sequence | Type of change |
|---|---|
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMTEN_PEA_1_P10 (SEQ ID NO: 938) also has the following non-silent SNPs (Single Nucleotide Polymorphisms) as listed in Table 20, (given according to their position(s) on the amino acid sequence, with the alternative amino acid(s) listed; the last column indicates whether the SNP is known or not; the presence of known SNPs in variant protein HUMTEN_PEA_1_P10 (SEQ ID NO: 938) sequence provides support for the deduced sequence of this variant protein according to the present invention).

TABLE 20

Amino acid mutations

| SNP position(s) on amino acid sequence | Alternative amino acid(s) | Previously known SNP? |
|---|---|---|
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 1066 | R -> H | No |
| 1586 | L -> I | Yes |
| 1690 | A -> T | Yes |
| 1917 | Q -> E | Yes |
| 1939 | K -> | No |
| 1947 | Q -> | No |
| 1976 | Q -> | No |
| 2082 | K -> | No |
| 2108 | K -> | No |
| 2108 | K -> Q | No |

Variant protein HUMTEN_PEA_1_P10 (SEQ ID NO: 938) is encoded by the following transcript(s): HUMTEN_PEA_1_T11 (SEQ ID NO: 861), for which the sequence(s) is/are given at the end of the application. The coding portion of transcript HUMTEN_PEA_1_T11 (SEQ ID NO: 861) is shown in bold; this coding portion starts at position 348 and ends at position 6677. The transcript also has the following SNPs as listed in Table 21 (given according to their position on the nucleotide sequence, with the alternative nucleic acid listed; the last column indicates whether the SNP is known or not; the presence of known SNPs in variant protein HUMTEN_PEA_1_P10 (SEQ ID NO: 938) sequence provides support for the deduced sequence of this variant protein according to the present invention).

TABLE 21

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |
| 3512 | C -> T | Yes |
| 3544 | G -> A | No |
| 3635 | A -> G | Yes |
| 4649 | G -> A | No |
| 5103 | T -> A | Yes |
| 5276 | A -> G | Yes |
| 5415 | G -> A | Yes |
| 5747 | A -> G | Yes |
| 5819 | C -> A | Yes |
| 6096 | C -> G | Yes |
| 6163 | A -> | No |
| 6187 | A -> | No |
| 6275 | G -> | No |
| 6323 | C -> T | Yes |
| 6593 | G -> | No |
| 6669 | A -> | No |
| 6669 | A -> C | No |
| 6684 | C -> G | Yes |
| 6685 | C -> G | Yes |
| 6687 | G -> | No |
| 6795 | G -> A | Yes |
| 6875 | A -> G | No |
| 7083 | A -> C | No |
| 7089 | T -> C | No |
| 7110 | -> T | No |
| 7279 | -> T | No |
| 7290 | A -> C | No |
| 7634 | G -> C | Yes |
| 8196 | G -> T | Yes |

Variant protein HUMTEN_PEA_1_P11 (SEQ ID NO: 939) according to the present invention has an amino acid sequence as given at the end of the application; it is encoded by transcript(s) HUMTEN_PEA_1_T14 (SEQ ID NO: 862). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P11 (SEQ ID NO: 939) and TENA_HUMAN_V1:

1. An isolated chimeric polypeptide encoding for HUMTEN_PEA_1_P11 (SEQ ID NO: 939), comprising a first amino acid sequence being at least 90% homologous to MGAMTQLLAGVFLAFLALATEGGV-
LKKVIRHKRQSGVNATLPEENQPVVFNHVYNIK
LPVGSQCSVDLESASGEKDLAPPSEPS- ESFQEHTVDGENQIVFTHRINIPRRACGCAAAP DVKELLSRLEELENLVSSLREQCTA- GAGCCLQPATGRLDTRPFCSGRGNFSTEGCGCVC EPGWKGPNCSEPECPGNCHLRGR- CIDGQCICDDGFTGEDCSQLACPSDCNDQGKCVNG VCICFEGYAGADCSREICPVPCSEEH- GTCVDGLCVCHDGFAGDDCNKPLCLNNCYNRG RCVENECVCDEGFTGEDCSELICPND- CFDRGRCINGTCYCEEGFTGEDCGKPTCPHACH TQGRCEEGQCVCDEGFAGVDCSEKRC- PADCHNRGRCVDGRCECDDGFTGADCGELKC PNGCSGHGRCVNGQCVCDEGYTGEDC- SQLRCPNDCHSRGRCVEGKCVCEQGFKGYDC SDM- SCPNDCHQHGRCVNGMCVCDDGYTGED- CRDRQCPRDCSNRGLCVDGQCVCEDG FTGPDCAELSCPNDCHGR- GRCVNGQCVCHEGFMGKDCKEQRCPSD- CHGQGRCVDGQ CICHEGFTGLDCGQHSCPSD- CNNLGQCVSGRCICNEGYSGEDCSEVSPPKDLVVTE VTE ETVNLAWDNEMRVTEYLVVYTPTHEG- GLEMQFRVPGDQTSTIIQELEPGVEYFIRVFAI LEN- KKSIPVSARVATYLPAPEGLKFK- SIKETSVEVEWDPLDIAFETWEIIFRNMNKEDEG EITKSLRRPETSYRQTGLAPGQEYEISL- HIVKNNTRGPGLKRVTTTRLDAPSQIEVKDVT DTTALITWFKPLAEIDGIELTYGIKD- VPGDRTTIDLTEDENQYSIGNLKPDTEYEVSLISRR GDMSSNPAKETFTTGLDAPRNLR- RVSQTDNSITLEWRNGKAAIDSYRIKYAPISGGDHA EVDVPKSQQATTKTTLTGLRPGTEY- GIGVSAVKEDKESNPATINAATELDTPKDLQVSE TAETSLTLLWKTPLAKFDRYRLNYSLPT- GQWVGVQLPRNTTSYVLRGLEPGQEYNVLL TAEKGRHKSKPARVKASTEQAPELEN- LTVTEVGWDGLRLNWTAADQAYEHFIIQVQE ANKVEAARNLTVPGSLRAVDIPGLKAAT- PYTVSIYGVIQ corresponding to amino acids 1-1149 of TENA_HUMAN_V1, which also corresponds to amino acids 1-1149 of HUMTEN_PEA__1_P11 (SEQ ID NO: 939), and a second amino acid sequence being at least 90% homologous to GYRTPVLSAEASTAKEPEIGNLNVSDIT- PESFNLSWMATDGIFETFTIEIIDSNRLLETVEY NIS- GAERTAHISGLPPSTDFIVYLSGLAP- SIRTKTISATATTEALPLLENLTISDINPYGFTV SWMASENAFDSFLVTVVDSGKLLD- PQEFTLSGTQRKLELRGLITGIGYEVMVSGFTQGH QTKPLRAEIVTEAEPEVDNLLVSDATP- DGFRLSWTADEGVFDNFVLKIRDTKKQSEPLEI TLLAPERTRDLTGLREATEYEIELY- GISKGRRSQTVSAIATTAMGSPKEVIFSDITENSAT VSWRAPTAQVESFRITYVPITGGTPSM- VTVDGTKTQTRLVKLIPGVEYLVSIIAMKGFEE SEPVSGSFTTALDGPSGLVTANITD- SEALARWQPAIATVDSYVISYTGEKVPEITRTVSG NTVEYALTDLEPATEYTLRIFAEKG- PQKSSTITAKFTTDLDSPRDLTATEVQSETALLTW RPPRASVTGYLLVYESVDGTVKEVIVGP- DTTSYSLADLSPSTHYTAKIQALNGPLRSNMI QTIFT- TIGLLYPFPKDCSQAMLNGDTTSG- LYTIYLNGDKAQALEVFCDMTSDGGGWIVF LRRKNGRENFYQNWKAYAAGFGDRREEF- WLGLDNLNKITAQGQYELRVDLRDHGET AFAVYD- KFSVGDAKTRYKLKVEGYSGTAGDS- MAYHNGRSFSTFDKDTDSAITNCALS YKGAFWYRNCHRVNLMGRYGDNNH- SQGVNWFHWKGHEHSIQFAEMKLRPSNFRNLE GRRKRA corresponding to amino acids 1423-2201 of TEN-A_HUMAN_V1, which also corresponds to amino acids 1150-1928 of HUMTEN_PEA__1_P11 (SEQ ID NO: 939), wherein said first amino acid sequence and second amino acid sequence are contiguous and in a sequential order.

2. An isolated chimeric polypeptide encoding for an edge portion of HUMTEN_PEA__1_P11 (SEQ ID NO: 939), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 1149−x to 1149; and ending at any of amino acid numbers 1150+((n−2)−x), in which x varies from 0 to n−2.

It should be noted that the known protein sequence (TEN-A_HUMAN) has one or more changes than the sequence given at the end of the application and named as being the amino acid sequence for TENA_HUMAN_V1. These changes were previously known to occur and are listed in the table below.

TABLE 22

Changes to TENA_HUMAN_V1

| SNP position(s) on amino acid sequence | Type of change |
|---|---|
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMTEN_PEA__1_P11 (SEQ ID NO: 939) also has the following non-silent SNPs (Single Nucleotide Polymorphisms) as listed in Table 23, (given according to their position(s) on the amino acid sequence, with the alternative amino acid(s) listed; the last column indicates whether the SNP is known or not; the presence of known SNPs in variant protein HUMTEN_PEA__1_P11 (SEQ ID NO: 939) sequence provides support for the deduced sequence of this variant protein according to the present invention).

TABLE 23

Amino acid mutations

| SNP position(s) on amino acid sequence | Alternative amino acid(s) | Previously known SNP? |
|---|---|---|
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 1066 | R -> H | No |
| 1404 | L -> I | Yes |

TABLE 23-continued

Amino acid mutations

| SNP position(s) on amino acid sequence | Alternative amino acid(s) | Previously known SNP? |
|---|---|---|
| 1508 | A -> T | Yes |
| 1735 | Q -> E | Yes |
| 1757 | K -> | No |
| 1765 | Q -> | No |
| 1794 | Q -> | No |
| 1900 | K -> | No |
| 1926 | K -> | No |
| 1926 | K -> Q | No |

Variant protein HUMTEN_PEA_1_P11 (SEQ ID NO: 939) is encoded by the following transcript(s): HUMTEN_PEA_1_T14 (SEQ ID NO: 862), for which the sequence(s) is/are given at the end of the application. The coding portion of transcript HUMTEN_PEA_1_T14 (SEQ ID NO: 862) is shown in bold; this coding portion starts at position 348 and ends at position 6131. The transcript also has the following SNPs as listed in Table 24 (given according to their position on the nucleotide sequence, with the alternative nucleic acid listed; the last column indicates whether the SNP is known or not; the presence of known SNPs in variant protein HUMTEN_PEA_1_P11 (SEQ ID NO: 939) sequence provides support for the deduced sequence of this variant protein according to the present invention).

TABLE 24

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |
| 3512 | C -> T | Yes |
| 3544 | G -> A | No |
| 3635 | A -> G | Yes |
| 4103 | G -> A | No |
| 4557 | T -> A | Yes |
| 4730 | A -> G | Yes |
| 4869 | G -> A | Yes |
| 5201 | A -> G | Yes |
| 5273 | C -> A | Yes |
| 5550 | C -> G | Yes |
| 5617 | A -> | No |
| 5641 | A -> | No |
| 5729 | G -> | No |
| 5777 | C -> T | Yes |
| 6047 | G -> | No |
| 6123 | A -> | No |
| 6123 | A -> C | No |
| 6138 | C -> G | Yes |
| 6139 | C -> G | Yes |
| 6141 | G -> | No |
| 6249 | G -> A | Yes |
| 6329 | A -> G | No |
| 6537 | A -> C | No |
| 6543 | T -> C | No |
| 6564 | -> T | No |
| 6733 | -> T | No |
| 6744 | A -> C | No |
| 7088 | G -> C | Yes |
| 7650 | G -> T | Yes |

Variant protein HUMTEN_PEA_1_P13 (SEQ ID NO: 940) according to the present invention has an amino acid sequence as given at the end of the application; it is encoded by transcript(s) HUMTEN_PEA_1_T16 (SEQ ID NO: 863). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P13 (SEQ ID NO: 940) and TENA_HUMAN_V1:

1. An isolated chimeric polypeptide encoding for HUMTEN_PEA_1_P13 (SEQ ID NO: 940), comprising a first amino acid sequence being at least 90% homologous to
MGAMTQLLAGVFLAFLALATEGGV-
LKKVIRHKRQSGVNATLPEENQPVVFNHVYNIK
LPVGSQCSVDLESASGEKDLAPPSEPS-
ESFQEHTVDGENQIVFTHRINIPRRACGCAAAP
DVKELLSRLEELENLVSSLREQCTA-
GAGCCLQPATGRLDTRPFCSGRGNFSTEGCGCVC
EPGWKGPNCSEPECPGNCHLRGR-
CIDGQCICDDGFTGEDCSQLACPSDCNDQGKCVNG
VCICFEGYAGADCSREICPVPCSEEH-
GTCVDGLCVCHDGFAGDDCNKPLCLNNCYNRG
RCVENECVCDEGFTGEDCSELICPND-
CFDRGRCINGTCYCEEGFTGEDCGKPTCPHACH
TQGRCEEGQCVCDEGFAGVDCSEKRC-
PADCHNRGRCVDGRCECDDGFTGADCGELKC
PNGCSGHGRCVNGQCVCDEGYTGEDC-
SQLRCPNDCHSRGRCVEGKCVCEQGFKGYDC SDM-
SCPNDCHQHGRCVNGMCVCDDGYTGED-
CRDRQCPRDCSNRGLCVDGQCVCEDG
FTGPDCAELSCPNDCHGR-
GRCVNGQCVCHEGFMGKDCKEQRCPSD-
CHGQGRCVDGQ CICHEGFTGLDCGQHSCPSD-
CNNLGQCVSGRCICNEGYSGEDCSEVSPPKDLVVTE
VTE ETVNLAWDNEMRVTEYLVVYTPTHEG-
GLEMQFRVPGDQTSTIIQELEPGVEYFIRVFAI LEN-
KKSIPVSARVATYLPAPEGLKFK-
SIKETSVEVEWDPLDIAFETWEIIFRNMNKEDEG
EITKSLRRPETSYRQTGLAPGQEYEISL-
HIVKNNTRGPGLKRVTTTRLDAPSQIEVKDVT
DTTALITWFKPLAEIDGIELTYGIKD-
VPGDRTTIDLTEDENQYSIGNLKPDTEYEVSLISRR
GDMSSNPAKETFTTGLDAPRNLR-
RVSQTDNSITLEWRNGKAAIDSYRIKYAPISGGDHA
EVDVPKSQQATTKTTLTGLRPGTEY-
GIGVSAVKEDKESNPATINAATELDTPKDLQVSE TAETSLTLLWKTPLAKFDRYRLNYSLPT-
GQWVGVQLPRNTTSYVLRGLEPGQEYNVLL
TAEKGRHKSKPARVKASTEQAPELEN-
LTVTEVGWDGLRLNWTAADQAYEHFIIQVQE
ANKVEAARNLTVPGSLRAVDIPGLKAAT-
PYTVSIYGVIQGYRTPVLSAEASTGETPNLG EVV-
VAEVGWDALKLNWTAPEGAYEY-
FFIQVQEADTVEAAQNLTVPGGLRSTDLPGLK
AATHYTITIRGVTQDFSTTPLSVEVL-
TEEVPDMGNLTVTEVSWDALRLNWTTPDGTYD QFT-
IQVQEADQVEEAHNLTVPGSLRS-
MEIPGLRAGTPYTVTLHGEVRGHSTRPLAVEVV
corresponding to amino acids 1-1343 of TENA_HU-
MAN_V1, which also corresponds to amino acids 1-1343 of
HUMTEN_PEA__1_P13 (SEQ ID NO: 940), and a second
amino acid sequence being at least 90% homologous to
TAMGSPKEVIFSDITEN-
SATVSWRAPTAQVESFRITYVPITG-
GTPSMVTVDGTKTQTRLV KLIPGVEYLVSIIAMKG-
FEESEPVSGSFTTALDGPSGLVTANITDSEALARWQP
AIATVDS YVISYTGEKVPEITRTVSGNTVEYALT-
DLEPATEYTLRIFAEKGPQKSSTITAKFTTDLDS PRDL-
TATEVQSETALLTWRPPRASVT-
GYLLVYESVDGTVKEVIVGPDTTSYSLADLSPS
THYTAKIQALNGPLRSNMIQTIFT-
TIGLLYPFPKDCSQAMLNGDTTSGLYTIYLNGDKAQ
ALEVFCDMTSDGGGWIVFLRRKNGREN-
FYQNWKAYAAGFGDRREEFWLGLDNLNKIT
AQGQYELRVDLRDHGETAFAVYDKFS-
VGDAKTRYKLKVEGYSGTAGDSMAYHNGRS FSTFD-
KDTDSAITNCALSYKGAFWYRNCHRVN-
LMGRYGDNNHSQGVNWFHWKGHEH
SIQFAEMKLRPSNFRNLEGRRKRA corresponding to
amino acids 1708-2201 of TENA_HUMAN_V1, which also
corresponds to amino acids 1344-1837 of HUMTEN_PEA__
1_P13 (SEQ ID NO: 940), wherein said first amino acid
sequence and second amino acid sequence are contiguous and
in a sequential order.

2. An isolated chimeric polypeptide encoding for an edge portion of HUMTEN_PEA__1_P13 (SEQ ID NO: 940), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise VT, having a structure as follows: a sequence starting from any of amino acid numbers 1343−x to 1343; and ending at any of amino acid numbers 1344+((n−2)−x), in which x varies from 0 to n−2.

It should be noted that the known protein sequence (TEN-A_HUMAN) has one or more changes than the sequence given at the end of the application and named as being the amino acid sequence for TENA_HUMAN_V1. These changes were previously known to occur and are listed in the table below.

TABLE 25

Changes to TENA_HUMAN_V1

| SNP position(s) on amino acid sequence | Type of change |
|---|---|
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMTEN_PEA__1_P13 (SEQ ID NO: 940) also has the following non-silent SNPs (Single Nucleotide Polymorphisms) as listed in Table 26, (given according to their position(s) on the amino acid sequence, with the alternative amino acid(s) listed; the last column indicates whether the SNP is known or not; the presence of known SNPs in variant protein HUMTEN_PEA__1_P13 (SEQ ID NO: 940) sequence provides support for the deduced sequence of this variant protein according to the present invention).

TABLE 26

Amino acid mutations

| SNP position(s) on amino acid sequence | Alternative amino acid(s) | Previously known SNP? |
|---|---|---|
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 1066 | R -> H | No |
| 1417 | A -> T | Yes |
| 1644 | Q -> E | Yes |
| 1666 | K -> | No |
| 1674 | Q -> | No |
| 1703 | Q -> | No |
| 1809 | K -> | No |
| 1835 | K -> | No |
| 1835 | K -> Q | No |

Variant protein HUMTEN_PEA__1_P13 (SEQ ID NO: 940) is encoded by the following transcript(s): HUMTEN_PEA__1_T16 (SEQ ID NO: 863), for which the sequence(s) is/are given at the end of the application. The coding portion of transcript HUMTEN_PEA__1_T16 (SEQ ID NO: 863) is shown in bold; this coding portion starts at position 348 and ends at position 5858. The transcript also has the following SNPs as listed in Table 27 (given according to their position on the nucleotide sequence, with the alternative nucleic acid listed; the last column indicates whether the SNP is known or not; the presence of known SNPs in variant protein HUMTEN_PEA__1_P13 (SEQ ID NO: 940) sequence provides support for the deduced sequence of this variant protein according to the present invention).

TABLE 27

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |

TABLE 27-continued

Nucleic acid SNPs

| SNP position on nucleotide sequence | Alternative nucleic acid | Previously known SNP? |
|---|---|---|
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |
| 3512 | C -> T | Yes |
| 3544 | G -> A | No |
| 3635 | A -> G | Yes |
| 4457 | A -> G | Yes |
| 4596 | G -> A | Yes |
| 4928 | A -> G | Yes |
| 5000 | C -> A | Yes |
| 5277 | C -> G | Yes |
| 5344 | A -> | No |
| 5368 | A -> | No |
| 5456 | G -> | No |
| 5504 | C -> T | Yes |
| 5774 | G -> | No |
| 5850 | A -> | No |
| 5850 | A -> C | No |
| 5865 | C -> G | Yes |
| 5866 | C -> G | Yes |
| 5868 | G -> | No |
| 5976 | G -> A | Yes |
| 6056 | A -> G | No |
| 6264 | A -> C | No |
| 6270 | T -> C | No |
| 6291 | -> T | No |
| 6460 | -> T | No |
| 6471 | A -> C | No |
| 6815 | G -> C | Yes |
| 7377 | G -> T | Yes |

Variant protein HUMTEN_PEA_1_P14 (SEQ ID NO: 941) according to the present invention has an amino acid sequence as given at the end of the application; it is encoded by transcript(s) HUMTEN_PEA_1_T17 (SEQ ID NO: 864). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P14 (SEQ ID NO: 941) and TENA_HUMAN_V1:

1. An isolated chimeric polypeptide encoding for HUMTEN_PEA_1_P14 (SEQ ID NO: 941), comprising a first amino acid sequence being at least 90% homologous to MGAMTQLLAGVFLAFLALATEGGV-
LKKVIRHKRQSGVNATLPEENQPVVFNHVYNIK
LPVGSQCSVDLESASGEKDLAPPSEPS-
ESFQEHTVDGENQIVFTHRINIPRRACGCAAAP
DVKELLSRLEELENLVSSLREQCTA-
GAGCCLQPATGRLDTRPFCSGRGNFSTEGCGCVC
EPGWKGPNCSEPECPGNCHLRGR-
CIDGQCICDDGFTGEDCSQLACPSDCNDQGKCVNG
VCICFEGYAGADCSREICPVPCSEEH-
GTCVDGLCVCHDGFAGDDCNKPLCLNNCYNRG
RCVENECVCDEGFTGEDCSELICPND-
CFDRGRCINGTCYCEEGFTGEDCGKPTCPHACH
TQGRCEEGQCVCDEGFAGVDCSEKRC-
PADCHNRGRCVDGRCECDDGFTGADCGELKC
PNGCSGHGRCVNGQCVCDEGYTGEDC-
SQLRCPNDCHSRGRCVEGKCVCEQGFKGYDC SDM-
SCPNDCHQHGRCVNGMCVCDDGYTGED-
CRDRQCPRDCSNRGLCVDGQCVCEDG
FTGPDCAELSCPNDCHGR-
GRCVNGQCVCHEGFMGKDCKEQRCPSD-
CHGQGRCVDGQ CICHEGFTGLDCGQHSCPSD-
CNNLGQCVSGRCICNEGYSGEDCSEVSPPKDLVVTE
VTE ETVNLAWDNEMRVTEYLVVYTPTHEG-
GLEMQFRVPGDQTSTIIQELEPGVEYFIRVFAI LEN-
KKSIPVSARVATYLPAPEGLKFK-
SIKETSVEVEWDPLDIAFETWEIIFRNMNKEDEG
EITKSLRRPETSYRQTGLAPGQEYEISL-
HIVKNNTRGPGLKRVTTRLDAPSQIEVKDVT
DTTALITWFKPLAEIDGIELTYGIKD-
VPGDRTTIDLTEDENQYSIGNLKPDTEYEVSLISRR
GDMSSNPAKETFTTGLDAPRNLR-
RVSQTDNSITLEWRNGKAAIDSYRIKYAPISGGDHA
EVDVPKSQQATTKTTLTGLRPGTEY-
GIGVSAVKEDKESNPATINAATELDTPKDLQVSE
TAETSLTLLWKTPLAKFDRYRLNYSLPT-
GQWVGVQLPRNTTSYVLRGLEPGQEYNVLL
TAEKGRHKSKPARVKASTEQAPELEN-
LTVTEVGWDGLRLNWTAADQAYEHFIIQVQE
ANKVEAARNLTVPGSLRAVDIPGLKAAT-
PYTVSIYGVIQGYRTPVLSAEASTGETPNLG EVV-
VAEVGWDALKLNWTAPEGAYEY-
FFIQVQEADTVEAAQNLTVPGGLRSTDLPGLK
AATHYTITIRGVTQDFSTTPLSVEVL-
TEEVPDMGNLTVTEVSWDALRLNWTTPDGTYD QFT-
IQVQEADQVEEAHNLTVPGSLRS-
MEIPGLRAGTPYTVTLHGEVRGHSTRPLAVEVV
TEDLPQLGDLAVSEVGWDGLRLNWTAAD-
NAYEHFVIQVQEVNKVEAAQNLTLPGSLR
AVDIPGLEAATPYRVSIYGVIRGYRTPV-
LSAEASTAKEPEIGNLNVSDITPESFNLSWMA TDG-
IFETFTIEIIDSNRLLETVEYNISGAER-
TAHISGLPPSTDFIVYLSGLAPSIRTKTISATA
TTEALPLLENLTISDINPYGFTVSW-
MASENAFDSFLVTVVDSGKLLDPQEFTLSGTQRKL
ELRGLITGIGYEVMVSGFTQGHQTKPL-
RAEIVTEAEPEVDNLLVSDATPDGFRLSWTAD
EGVFDNFVLKIRDTKKQSEPLEITLLAP-
ERTRDLTGLREATEYEIELYGISKGRRSQTVSA IAT-
TAMGSPKEVIFSDITEN-
SATVSWRAPTAQVESFRITYVPITGGTPSMVTVDGTK
TQT RLVKLIPGVEYLVSIIAMKG-
FEESEPVSGSFTTALDGPSGLVTANITD-
SEALARWQPAIAT VDSYVISYTGEKVPEITRTVS-
GNTVEYALTDLEPATEYTLRIFAEKGPQKSSTITAKFT
TD LDSPRDLTATEVQSETALLTWRPPRAS-
VTGYLLVYESVDGTVKEVIVGPDTTSYSLADL
SPSTHYTAKIQALNGPLRSNMIQTIFT-
TIGLLYPFPKDCSQAMLNGDTTSGLYTIYLNGD
KAQALEVFCDMTSDGGGWIV corresponding to amino acids 1-2025 of TENA_HUMAN_V1, which also corresponds to amino acids 1-2025 of HUMTEN_PEA_1_P14 (SEQ ID NO: 941), and a second amino acid sequence being at least 70%, optionally at least 80%, preferably at least 85%, more preferably at least 90% and most preferably at least 95% homologous to a polypeptide having the sequence STTRD- CRALRPRGRGRGQSRGGEEGDLLLMHS-
DTPMCEALQDSACHTEALRNSLLNKR MGNTLATF
(SEQ ID NO: 1100) corresponding to amino acids 2026-2091
of HUMTEN_PEA_1_P14 (SEQ ID NO: 941), wherein said
first amino acid sequence and second amino acid sequence
are contiguous and in a sequential order.

2. An isolated polypeptide encoding for a tail of HUMTEN_PEA_1_P14 (SEQ ID NO: 941), comprising a polypeptide being at least 70%, optionally at least about 80%, preferably at least about 85%, more preferably at least about 90% and most preferably at least about 95% homologous to the sequence STTRDCRALRPRGRGRGQSRGGEE-GDLLLMHSDTPMCEALQDSACHTEALRNSLLNKR MGNTLATF (SEQ ID NO: 1100) in HUMTEN_PEA_1_P14 (SEQ ID NO: 941).

It should be noted that the known protein sequence (TEN-A_HUMAN) has one or more changes than the sequence given at the end of the application and named as being the amino acid sequence for TENA_HUMAN_V1. These changes were previously known to occur and are listed in the table below.

TABLE 28

Changes to TENA_HUMAN_V1

| SNP position(s) on amino acid sequence | Type of change |
| --- | --- |
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMTEN_PEA_1_P14 (SEQ ID NO: 941) also has the following non-silent SNPs (Single Nucleotide Polymorphisms) as listed in Table 29, (given according to their position(s) on the amino acid sequence, with the alternative amino acid(s) listed; the last column indicates whether the SNP is known or not; the presence of known SNPs in variant protein HUMTEN_PEA_1_P14 (SEQ ID NO: 941) sequence provides support for the deduced sequence of this variant protein according to the present invention).

TABLE 29

Amino acid mutations

| SNP position(s) on amino acid sequence | Alternative amino acid(s) | Previously known SNP? |
| --- | --- | --- |
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 1066 | R -> H | No |
| 1677 | L -> I | Yes |
| 1781 | A -> T | Yes |
| 2008 | Q -> E | Yes |

TABLE 29-continued

Amino acid mutations

| SNP position(s) on amino acid sequence | Alternative amino acid(s) | Previously known SNP? |
| --- | --- | --- |
| 2060 | P -> H | Yes |

Variant protein HUMTEN_PEA_1_P14 (SEQ ID NO: 941) is encoded by the following transcript(s): HUMTEN_PEA_1_T17 (SEQ ID NO: 864), for which the sequence(s) is/are given at the end of the application. The coding portion of transcript HUMTEN_PEA_1_T17 (SEQ ID NO: 864) is shown in bold; this coding portion starts at position 348 and ends at position 6620. The transcript also has the following SNPs as listed in Table 30 (given according to their position on the nucleotide sequence, with the alternative nucleic acid listed; the last column indicates whether the SNP is known or not; the presence of known SNPs in variant protein HUMTEN_PEA_1_P14 (SEQ ID NO: 941) sequence provides support for the deduced sequence of this variant protein according to the present invention).

TABLE 30

Nucleic acid SNPs

| SNP position on nucleotide sequence | Alternative nucleic acid | Previously known SNP? |
| --- | --- | --- |
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |
| 3512 | C -> T | Yes |
| 3544 | G -> A | No |
| 3635 | A -> G | Yes |
| 4922 | G -> A | No |
| 5376 | T -> A | Yes |
| 5549 | A -> G | Yes |
| 5688 | G -> A | Yes |
| 6020 | A -> G | Yes |
| 6092 | C -> A | Yes |
| 6369 | C -> G | Yes |
| 6526 | C -> A | Yes |
| 6678 | C -> G | Yes |
| 7233 | A -> | No |
| 7257 | A -> | No |
| 7345 | G -> | No |
| 7393 | C -> T | Yes |
| 7663 | G -> | No |
| 7739 | A -> | No |
| 7739 | A -> C | No |
| 7754 | C -> G | Yes |
| 7755 | C -> G | Yes |
| 7757 | G -> | No |
| 7865 | G -> A | Yes |
| 7945 | A -> G | No |

TABLE 30-continued

Nucleic acid SNPs

| SNP position on nucleotide sequence | Alternative nucleic acid | Previously known SNP? |
|---|---|---|
| 8153 | A -> C | No |
| 8159 | T -> C | No |
| 8180 | -> T | No |
| 8349 | -> T | No |
| 8360 | A -> C | No |
| 8704 | G -> C | Yes |
| 9266 | G -> T | Yes |

Variant protein HUMTEN_PEA_1_P15 (SEQ ID NO: 942) according to the present invention has an amino acid sequence as given at the end of the application; it is encoded by transcript(s) HUMTEN_PEA_1_T18 (SEQ ID NO: 865). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P15 (SEQ ID NO: 942) and TENA_HUMAN_V1:

1. An isolated chimeric polypeptide encoding for HUMTEN_PEA_1_P15 (SEQ ID NO: 942), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTRLDAPSQIEVKDVT DTTALITWFKPLAEIDGIELTYGIKD-VPGDRTTIDLTEDENQYSIGNLKPDTEYEVSLISRR GDMSSNPAKETFTTGLDAPRNLR-RVSQTDNSITLEWRNGKAAIDSYRIKYAPISGGDHA EVDVPKSQQATTKTTLTGLRPGTEY-GIGVSAVKEDKESNPATINAATELDTPKDLQVSE TAETSLTLLWKTPLAKFDRYRLNYSLPT-GQWVGVQLPRNTTSYVLRGLEPGQEYNVLL TAEKGRHKSKPARVKAS corresponding to amino acids 1-1070 of TENA_HUMAN_V1, which also corresponds to amino acids 1-1070 of HUMTEN_PEA_1_P15 (SEQ ID NO: 942), and a second amino acid sequence being at least 90% homologous to TEAEPEVDNLLVSDATPDG-FRLSWTADEGVFDNFVLKIRDTKKQSE-PLEITLLAPERTRD LTGLREATEYEIELYGISKGRR-SQTVSAIATTAMGSPKEVIFSDITENSATVSWRAPTA QV ESFRITYVPITGGTPSMVTVDGTKTQTR-LVKLIPGVEYLVSIIAMKGFEESEPVSGSFTTA LDGPS-GLVTANITDSEALARWQPAIATVDSYVI-SYTGEKVPEITRTVSGNTVEYALTDLE PATEYTLRIFAEKGPQKSSTITAK-FTTDLDSPRDLTATEVQSETALLTWRPPRASVTGYL LVYESVDGTVKEVIVGPDTTSYSLADL-SPSTHYTAKIQALNGPLRSNMIQTIFTTIGLLYP FPKDCSQAMLNGDTTSGLYTIYLNGD-KAQALEVFCDMTSDGGGWIVFLRRKNGRENF YQN-WKAYAAGFGDRREEFWLGLDNLNKI-TAQGQYELRVDLRDHGETAFAVYDKFSV GDAKTRYKLKVEGYSGTAGDSMAYH-NGRSFSTFDKDTDSAITNCALSYKGAFWYRNC HRVNLMGRYGDNNHSQGVNWFHWKGHEH-SIQFAEMKLRPSNFRNLEGRRKRA corresponding to amino acids 1617-2201 of TENA_HUMAN_V1, which also corresponds to amino acids 1071-1655 of HUMTEN_PEA_1_P15 (SEQ ID NO: 942), wherein said first amino acid sequence and second amino acid sequence are contiguous and in a sequential order.

2. An isolated chimeric polypeptide encoding for an edge portion of HUMTEN_PEA_1_P15 (SEQ ID NO: 942), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise ST, having a structure as follows: a sequence starting from any of amino acid numbers 1070-x to 1070; and ending at any of amino acid numbers 1071+((n-2)-x), in which x varies from 0 to n-2.

It should be noted that the known protein sequence (TEN-A_HUMAN) has one or more changes than the sequence given at the end of the application and named as being the amino acid sequence for TENA_HUMAN_V1. These changes were previously known to occur and are listed in the table below.

TABLE 31

Changes to TENA_HUMAN_V1

| SNP position(s) on amino acid sequence | Type of change |
|---|---|
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTEN_PEA_1_P15 (SEQ ID NO: 942) also has the following non-silent SNPs (Single Nucleotide Polymorphisms) as listed in Table 32, (given according to their position(s) on the amino acid sequence, with the alternative amino acid(s) listed; the last column indicates whether the SNP is known or not; the presence of known SNPs in variant protein HUMTEN_PEA_1_P15 (SEQ ID NO: 942) sequence provides support for the deduced sequence of this variant protein according to the present invention).

TABLE 32

Amino acid mutations

| SNP position(s) on amino acid sequence | Alternative amino acid(s) | Previously known SNP? |
|---|---|---|
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 1066 | R -> H | No |
| 1131 | L -> I | Yes |
| 1235 | A -> T | Yes |
| 1462 | Q -> E | Yes |
| 1484 | K -> | No |
| 1492 | Q -> | No |
| 1521 | Q -> | No |
| 1627 | K -> | No |
| 1653 | K -> | No |
| 1653 | K -> Q | No |

Variant protein HUMTEN_PEA_1_P15 (SEQ ID NO: 942) is encoded by the following transcript(s): HUMTEN_PEA_1_T18 (SEQ ID NO: 865), for which the sequence(s) is/are given at the end of the application. The coding portion of transcript HUMTEN_PEA_1_T18 (SEQ ID NO: 865) is shown in bold; this coding portion starts at position 348 and ends at position 5312. The transcript also has the following SNPs as listed in Table 33 (given according to their position on the nucleotide sequence, with the alternative nucleic acid listed; the last column indicates whether the SNP is known or not; the presence of known SNPs in variant protein HUMTEN_PEA_1_P15 (SEQ ID NO: 942) sequence provides support for the deduced sequence of this variant protein according to the present invention).

TABLE 33

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |

TABLE 33-continued

Nucleic acid SNPs

| SNP position on nucleotide sequence | Alternative nucleic acid | Previously known SNP? |
|---|---|---|
| 2871 | G -> T | No |
| 2895 | G -> C | Yes |
| 2898 | C -> G | Yes |
| 3005 | A -> G | No |
| 3512 | C -> T | Yes |
| 3544 | G -> A | No |
| 3738 | T -> A | Yes |
| 3911 | A -> G | Yes |
| 4050 | G -> A | Yes |
| 4382 | A -> G | Yes |
| 4454 | C -> A | Yes |
| 4731 | C -> G | Yes |
| 4798 | A -> | No |
| 4822 | A -> | No |
| 4910 | G -> | No |
| 4958 | C -> T | Yes |
| 5228 | G -> | No |
| 5304 | A -> | No |
| 5304 | A -> C | No |
| 5319 | C -> G | Yes |
| 5320 | C -> G | Yes |
| 5322 | G -> | No |
| 5430 | G -> A | Yes |
| 5510 | A -> G | No |
| 5718 | A -> C | No |
| 5724 | T -> C | No |
| 5745 | -> T | No |
| 5914 | -> T | No |
| 5925 | A -> C | No |
| 6269 | G -> C | Yes |
| 6831 | G -> T | Yes |

Variant protein HUMTEN_PEA_1_P16 (SEQ ID NO: 943) according to the present invention has an amino acid sequence as given at the end of the application; it is encoded by transcript(s) HUMTEN_PEA_1_T19 (SEQ ID NO: 866). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P16 (SEQ ID NO: 943) and TENA_HUMAN_V1:

1. An isolated chimeric polypeptide encoding for HUMTEN_PEA_1_P16 (SEQ ID NO: 943), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR- GRCVNGQCVCHEGFMGKDCKEQRCPSD-
CHGQGRCVDGQ CICHEGFTGLDCGQHSCPSD-
CNNLGQCVSGRCICNEGYSGEDCSEVSPPKDLVVTE
VTE ETVNLAWDNEMRVTEYLVVYTPTHEG-
GLEMQFRVPGDQTSTIIQELEPGVEYFIRVFAI LEN-
KKSIPVSARVATYLPAPEGLKFK-
SIKETSVEVEWDPLDIAFETWEIIFRNMNKEDEG
EITKSLRRPETSYRQTGLAPGQEYEISL-
HIVKNNTRGPGLKRVTTTRLDAPSQIEVKDVT
DTTALITWFKPLAEIDGIELTYGIKD-
VPGDRTTIDLTEDENQYSIGNLKPDTEYEVSLISRR
GDMSSNPAKETFTTGLDAPRNLR-
RVSQTDNSITLEWRNGKAAIDSYRIKYAPISGGDHA
EVDVPKSQQATTKTTLTGLRPGTEY-
GIGVSAVKEDKESNPATINAATELDTPKDLQVSE
TAETSLTLLWKTPLAKFDRYRLNYSLPT-
GQWVGVQLPRNTTSYVLRGLEPGQEYNVLL
TAEKGRHKSKPARVKAS corresponding to amino acids 1-1070 of TENA_HUMAN_V1, which also corresponds to amino acids 1-1070 of HUMTEN_PEA_1_P16 (SEQ ID NO: 943), and a second amino acid sequence being at least 90% homologous to TAMGSPKEVIFSDITEN-
SATVSWRAPTAQVESFRITYVPITG-
GTPSMVTVDGTKTQTRLV KLIPGVEYLVSIIAMKG-
FEESEPVSGSFTTALDGPSGLVTANITDSEALARWQP
AIATVDS YVISYTGEKVPEITRTVSGNTVEYALT-
DLEPATEYTLRIFAEKGPQKSSTITAKFTTDLDS PRDL-
TATEVQSETALLTWRPPRASVT-
GYLLVYESVDGTVKEVIVGPDTTSYSLADLSPS
THYTAKIQALNGPLRSNMIQTIFT-
TIGLLYPFPKDCSQAMLNGDTTSGLYTIYLNGDKAQ
ALEVFCDMTSDGGGWIVFLRRKNGREN-
FYQNWKAYAAGFGDRREEFWLGLDNLNKIT
AQGQYELRVDLRDHGETAFAVYDKFS-
VGDAKTRYKLKVEGYSGTAGDSMAYHNGRS FSTFD-
KDTDSAITNCALSYKGAFWYRNCHRVN-
LMGRYGDNNHSQGVNWFHWKGHEH
SIQFAEMKLRPSNFRNLEGRRKRA corresponding to amino acids 1708-2201 of TENA_HUMAN_V1, which also corresponds to amino acids 1071-1564 of HUMTEN_PEA_1_P16 (SEQ ID NO: 943), wherein said first amino acid sequence and second amino acid sequence are contiguous and in a sequential order.

2. An isolated chimeric polypeptide encoding for an edge portion of HUMTEN_PEA_1_P16 (SEQ ID NO: 943), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise ST, having a structure as follows: a sequence starting from any of amino acid numbers 1070-x to 1070; and ending at any of amino acid numbers 1071+((n-2)-x)) in which x varies from 0 to n-2.

It should be noted that the known protein sequence (TENA_HUMAN) has one or more changes than the sequence given at the end of the application and named as being the amino acid sequence for TENA_HUMAN_V1. These changes were previously known to occur and are listed in the table below.

TABLE 34

Changes to TENA_HUMAN_V1

| SNP position(s) on amino acid sequence | Type of change |
|---|---|
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMTEN_PEA_1_P16 (SEQ ID NO: 943) also has the following non-silent SNPs (Single Nucleotide Polymorphisms) as listed in Table 35, (given according to their position(s) on the amino acid sequence, with the alternative amino acid(s) listed; the last column indicates whether the SNP is known or not; the presence of known SNPs in variant protein HUMTEN_PEA_1_P16 (SEQ ID NO: 943) sequence provides support for the deduced sequence of this variant protein according to the present invention).

TABLE 35

Amino acid mutations

| SNP position(s) on amino acid sequence | Alternative amino acid(s) | Previously known SNP? |
|---|---|---|
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 1066 | R -> H | No |
| 1144 | A -> T | Yes |
| 1371 | Q -> E | Yes |
| 1393 | K -> | No |
| 1401 | Q -> | No |
| 1430 | Q -> | No |
| 1536 | K -> | No |
| 1562 | K -> | No |
| 1562 | K -> Q | No |

Variant protein HUMTEN_PEA_1_P16 (SEQ ID NO: 943) is encoded by the following transcript(s): HUMTEN_PEA_1_T19 (SEQ ID NO: 866), for which the sequence(s) is/are given at the end of the application. The coding portion of transcript HUMTEN_PEA_1_T19 (SEQ ID NO: 866) is shown in bold; this coding portion starts at position 348 and ends at position 5039. The transcript also has the following SNPs as listed in Table 36 (given according to their position on the nucleotide sequence, with the alternative nucleic acid listed; the last column indicates whether the SNP is known or not; the presence of known SNPs in variant protein HUMTEN_PEA_1_P16 (SEQ ID NO: 943) sequence provides support for the deduced sequence of this variant protein according to the present invention).

TABLE 36

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |
| 3512 | C -> T | Yes |
| 3544 | G -> A | No |
| 3638 | A -> G | Yes |
| 3777 | G -> A | Yes |
| 4109 | A -> G | Yes |
| 4181 | C -> A | Yes |
| 4458 | C -> G | Yes |
| 4525 | A -> | No |
| 4549 | A -> | No |
| 4637 | G -> | No |
| 4685 | C -> T | Yes |
| 4955 | G -> | No |
| 5031 | A -> | No |
| 5031 | A -> C | No |
| 5046 | C -> G | Yes |
| 5047 | C -> G | Yes |
| 5049 | G -> | No |
| 5157 | G -> A | Yes |
| 5237 | A -> G | No |
| 5445 | A -> C | No |
| 5451 | T -> C | No |
| 5472 | -> T | No |
| 5641 | -> T | No |
| 5652 | A -> C | No |
| 5996 | G -> C | Yes |
| 6558 | G -> T | Yes |

Variant protein HUMTEN_PEA_1_P17 (SEQ ID NO: 944) according to the present invention has an amino acid sequence as given at the end of the application; it is encoded by transcript(s) HUMTEN_PEA_1_T20 (SEQ ID NO. 867). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P17 (SEQ ID NO: 944) and TENA_HUMAN_V1:

1. An isolated chimeric polypeptide encoding for HUMTEN_PEA_1_P17 (SEQ ID NO: 944), comprising a first amino acid sequence being at least 90% homologous to MGAMTQLLAGVFLAFLALATEGGV-
LKKVIRHKRQSGVNATLPEENQPVVFNHVYNIK
LPVGSQCSVDLESASGEKDLAPPSEPS-
ESFQEHTVDGENQIVFTHRINIPRRACGCAAAP
DVKELLSRLEELENLVSSLREQCTA-
GAGCCLQPATGRLDTRPFCSGRGNFSTEGCGCVC
EPGWKGPNCSEPECPGNCHLRGR-
CIDGQCICDDGFTGEDCSQLACPSDCNDQGKCVNG
VCICFEGYAGADCSREICPVPCSEEH-
GTCVDGLCVCHDGFAGDDCNKPLCLNNCYNRG
RCVENECVCDEGFTGEDCSELICPND-
CFDRGRCINGTCYCEEGFTGEDCGKPTCPHACH
TQGRCEEGQCVCDEGFAGVDCSEKRC-
PADCHNRGRCVDGRCECDDGFTGADCGELKC
PNGCSGHGRCVNGQCVCDEGYTGEDC-
SQLRCPNDCHSRGRCVEGKCVCEQGFKGYDC SDM-
SCPNDCHQHGRCVNGMCVCDDGYTGED-
CRDRQCPRDCSNRGLCVDGQCVCEDG
FTGPDCAELSCPNDCHGR-
GRCVNGQCVCHEGFMGKDCKEQRCPSD-
CHGQGRCVDGQ CICHEGFTGLDCGQHSCPSD-
CNNLGQCVSGRCICNEGYSGEDCSEVSPPKDLVVTE
VTE ETVNLAWDNEMRVTEYLVVYTPTHEG-
GLEMQFRVPGDQTSTIIQELEPGVEYFIRVFAI LEN-
KKSIPVSARVATYLPAPEGLKFK-
SIKETSVEVEWDPLDIAFETWEIIFRNMNKEDEG
EITKSLRRPETSYRQTGLAPGQEYEISL-
HIVKNNTRGPGLKRVTTTRLDAPSQIEVKDVT
DTTALITWFKPLAEIDGIELTYGIKD-
VPGDRTTIDLTEDENQYSIGNLKPDTEYEVSLISRR
GDMSSNPAKETFTTGLDAPRNLR-
RVSQTDNSITLEWRNGKAAIDSYRIKYAPISGGDHA
EVDVPKSQQATTKTTLTGLRPGTEY-
GIGVSAVKEDKESNPATINAATELDTPKDLQVSE
TAETSLTLLWKTPLAKFDRYRLNYSLPT-
GQWVGVQLPRNTTSYVLRGLEPGQEYNVLL
TAEKGRHKSKPARVKASTEQAPELEN-
LTVTEVGWDGLRLNWTAADQAYEHFIIQVQE
ANKVEAARNLTVPGSLRAVDIPGLKAAT-
PYTVSIYGVIQGYRTPVLSAEASTGETPNLG EVV-
VAEVGWDALKLNWTAPEGAYEY-
FFIQVQEADTVEAAQNLTVPGGLRSTDLPGLK
AATHYTITIRGVTQDFSTTPLSVEVL-
TEEVPDMGNLTVTEVSWDALRLNWTTPDGTYD QFT-
IQVQEADQVEEAHNLTVPGSLRS-
MEIPGLRAGTPYTVTLHGEVRGHSTRPLAVEVV
TEDLPQLGDLAVSEVGWDGLRLNWTAAD-
NAYEHFVIQVQEVNKVEAAQNLTLPGSLR
AVDIPGLEAATPYRVSIYGVIRGYRTPV-
LSAEASTAKEPEIGNLNVSDITPESFNLSWMA TDG-
IFETFTIEIIDSNRLLETVEYNISGAER-
TAHISGLPPSTDFIVYLSGLAPSIRTKTISATA
TTEALPLLENLTISDINPYGFTVSW-
MASENAFDSFLVTVVDSGKLLDPQEFTLSGTQRKL
ELRGLITGIGYEVMVSGFTQGHQTKPL-
RAEIVTEAEPEVDNLLVSDATPDGFRLSWTAD
EGVFDNFVLKIRDTKKQSEPLEITLLAP-
ERTRDLTGLREATEYEIELYGISKGRRSQTVSA IAT-
TAMGSPKEVIFSDITEN-
SATVSWRAPTAQVESFRITYVPITGGTPSMVTVDGTK
TQT RLVKLIPGVEYLVSIIAMKG-
FEESEPVSGSFTTALDGPSGLVTANITD-
SEALARWQPAIAT VDSYVISYTGEKVPEITRTVS-
GNTVEYALTDLEPATEYTLRIFAEKGPQKSSTITAKFT
TD LDSPRDLTATEVQSETALLTWRPPRAS-
VTGYLLVYESVDGTVKEVIVGPDTTSYSLADL
SPSTHYTAKIQALNGPLRSNMIQTIFT-
TIGLLYPFPKDCSQAMLNGDTTSGLYTIYLNGD
KAQALEVFCDMTSDGGGWIV corresponding to amino acids 1-2025 of TENA_HUMAN_V1, which also corresponds to amino acids 1-2025 of HUMTEN_PEA_1_P17 (SEQ ID NO: 944), and a second amino acid sequence being at least 70%, optionally at least 80%, preferably at least 85%, more preferably at least 90% and most preferably at least 95% homologous to a polypeptide having the sequence TPWPTT-MADPSPPLTRTQIQPSPTVLCPTKGLSGTGTVTVST (SEQ ID NO: 1101) corresponding to amino acids 2026-2067 of HUMTEN_PEA_1_P17 (SEQ ID NO: 944), wherein said first amino acid sequence and second amino acid sequence are contiguous and in a sequential order.

2. An isolated polypeptide encoding for a tail of HUMTEN_PEA_1_P17 (SEQ ID NO: 944), comprising a polypeptide being at least 70%, optionally at least about 80%, preferably at least about 85%, more preferably at least about 90% and most preferably at least about 95% homologous to the sequence TPWPTTMADPSPPLTRTQIQPSPTVL-CPTKGLSGTGTVTVST (SEQ ID NO: 1101) in HUMTEN_PEA_1_T17 (SEQ ID NO: 944).

It should be noted that the known protein sequence (TEN-A_HUMAN) has one or more changes than the sequence given at the end of the application and named as being the amino acid sequence for TENA_HUMAN_V1. These changes were previously known to occur and are listed in the table below.

TABLE 37

Changes to TENA_HUMAN_V1

| SNP position(s) on amino acid sequence | Type of change |
|---|---|
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMTEN_PEA_1_P17 (SEQ ID NO: 944) also has the following non-silent SNPs (Single Nucleotide Polymorphisms) as listed in Table 38, (given according to their position(s) on the amino acid sequence, with the alternative amino acid(s) listed; the last column indicates whether the SNP is known or not; the presence of known SNPs in variant protein HUMTEN_PEA_1_P17 (SEQ ID NO: 944) sequence provides support for the deduced sequence of this variant protein according to the present invention).

TABLE 38

Amino acid mutations

| SNP position(s) on amino acid sequence | Alternative amino acid(s) | Previously known SNP? |
|---|---|---|
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 1066 | R -> H | No |
| 1677 | L -> I | Yes |
| 1781 | A -> T | Yes |
| 2008 | Q -> E | Yes |

Variant protein HUMTEN_PEA_1_P17 (SEQ ID NO: 944) is encoded by the following transcript(s): HUMTEN_PEA_1_T20 (SEQ ID NO. 867), for which the sequence(s) is/are given at the end of the application. The coding portion of transcript HUMTEN_PEA_1_T20 (SEQ ID NO. 867) is shown in bold; this coding portion starts at position 348 and ends at position 6548. The transcript also has the following SNPs as listed in Table 39 (given according to their position on the nucleotide sequence, with the alternative nucleic acid listed; the last column indicates whether the SNP is known or not; the presence of known SNPs in variant protein HUMTEN_PEA_1_P17 (SEQ ID NO: 944) sequence provides support for the deduced sequence of this variant protein according to the present invention).

TABLE 39

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |
| 3512 | C -> T | Yes |
| 3544 | G -> A | No |
| 3635 | A -> G | Yes |
| 4922 | G -> A | No |
| 5376 | T -> A | Yes |
| 5549 | A -> G | Yes |
| 5688 | G -> A | Yes |
| 6020 | A -> G | Yes |
| 6092 | C -> A | Yes |
| 6369 | C -> G | Yes |
| 6607 | G -> | No |
| 6683 | A -> | No |
| 6683 | A -> C | No |
| 6698 | C -> G | Yes |
| 6699 | C -> G | Yes |
| 6701 | G -> | No |
| 6809 | G -> A | Yes |
| 6889 | A -> G | No |
| 7097 | A -> C | No |
| 7103 | T -> C | No |
| 7124 | -> T | No |
| 7293 | -> T | No |
| 7304 | A -> C | No |
| 7648 | G -> C | Yes |
| 8210 | G -> T | Yes |

Variant protein HUMTEN_PEA_1_P20 (SEQ ID NO: 945) according to the present invention has an amino acid sequence as given at the end of the application; it is encoded by transcript(s) HUMTEN_PEA_1_T23 (SEQ ID NO: 868). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P20 (SEQ ID NO: 945) and TENA_HUMAN_V1:

1. An isolated chimeric polypeptide encoding for HUMTEN_PEA_1_P20 (SEQ ID NO: 945), comprising a first amino acid sequence being at least 90% homologous to MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDC SDM-SCPNDCHQHGRCVNGMCVCDDGYTGEDCRDRQCPRDCSNRGLCVDGQCVCEDG FTGPDCAELSCPNDCHGRGRCVNGQCVCHEGFMGKDCKEQRCPSDCHGQGRCVDGQ CICHEGFTGLDCGQHSCPSDCNNLGQCVSGRCICNEGYSGEDCSEVSPPKDLVVTE VTE ETVNLAWDNEMRVTEYLVVYTPTHEGGLEMQFRVPGDQTSTIIQELEPGVEYFIRVFAI LEN-KKSIPVSARVATYLPAPEGLKFK-SIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLG EVV-VAEVGWDALKLNWTAPEGAYEYFFIQVQEADTVEAAQNLTVPGGLRSTDLPGLK AATHYTITIRGVTQDFSTTPLSVEVL-TEEVPDMGNLTVTEVSWDALRLNWTTPDGTYD QFT-IQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMA TDG-IFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDLTGLREATEYEIELYGISKGRRSQTVSA IAT-TAMGSPKEVIFSDITENSATVSWRAPTAQVESFRITYVPITGGTPSMVTVDGT KTQT RLVKLIPGVEYLVSIIAMKGFEESEPVSGSFTTALDGPSGLVTANITDSEALARWQPAIAT VDSYVISYTGEKVPEITRTVSGNTVEYALTDLEPATEYTLRIFAEKGPQKSSTITAKFT TD LDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLG corresponding to amino acids 1-2057 of TENA_HUMAN_V1, which also corresponds to amino acids 1-2057 of HUMTEN_PEA_1_P20 (SEQ ID NO: 945), and a second amino acid sequence being at least 70%, optionally at least 80%, preferably at least 85%, more preferably at least 90% and most preferably at least 95% homologous to a polypeptide having the sequence NAALHVYI (SEQ ID NO: 1102) corresponding to amino acids 2058-2065 of HUMTEN_PEA_1_P20 (SEQ ID NO: 945), wherein said first amino acid sequence and second amino acid sequence are contiguous and in a sequential order.

2. An isolated polypeptide encoding for a tail of HUMTEN_PEA_1_P20 (SEQ ID NO: 945), comprising a polypeptide being at least 70%, optionally at least about 80%, preferably at least about 85%, more preferably at least about 90% and most preferably at least about 95% homologous to the sequence NAALHVYI (SEQ ID NO: 1102) in HUMTEN_PEA_1_P20 (SEQ ID NO: 945).

It should be noted that the known protein sequence (TEN-A_HUMAN) has one or more changes than the sequence given at the end of the application and named as being the amino acid sequence for TENA_HUMAN_V1. These changes were previously known to occur and are listed in the table below.

TABLE 40

Changes to TENA_HUMAN_V1

| SNP position(s) on amino acid sequence | Type of change |
|---|---|
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTEN_PEA_1_P20 (SEQ ID NO: 945) also has the following non-silent SNPs (Single Nucleotide Polymorphisms) as listed in Table 41, (given according to their position(s) on the amino acid sequence, with the alternative amino acid(s) listed; the last column indicates whether the SNP is known or not; the presence of known SNPs in variant protein HUMTEN_PEA_1_P20 (SEQ ID NO: 945) sequence provides support for the deduced sequence of this variant protein according to the present invention).

TABLE 41

Amino acid mutations

| SNP position(s) on amino acid sequence | Alternative amino acid(s) | Previously known SNP? |
|---|---|---|
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 1066 | R -> H | No |
| 1677 | L -> I | Yes |
| 1781 | A -> T | Yes |
| 2008 | Q -> E | Yes |
| 2030 | K -> | No |
| 2038 | Q -> | No |
| 2064 | Y -> C | Yes |

Variant protein HUMTEN_PEA_1_P20 (SEQ ID NO: 945) is encoded by the following transcript(s): HUMTEN_PEA_1_T23 (SEQ ID NO: 868), for which the sequence(s) is/are given at the end of the application. The coding portion of transcript HUMTEN_PEA_1_T23 (SEQ ID NO: 868) is shown in bold; this coding portion starts at position 348 and ends at position 6542. The transcript also has the following SNPs as listed in Table 42 (given according to their position on the nucleotide sequence, with the alternative nucleic acid listed; the last column indicates whether the SNP is known or not; the presence of known SNPs in variant protein HUMTEN_PEA_1_P20 (SEQ ID NO: 945) sequence provides support for the deduced sequence of this variant protein according to the present invention).

TABLE 42

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |
| 3512 | C -> T | Yes |
| 3544 | G -> A | No |
| 3635 | A -> G | Yes |
| 4922 | G -> A | No |
| 5376 | T -> A | Yes |
| 5549 | A -> G | Yes |
| 5688 | G -> A | Yes |
| 6020 | A -> G | Yes |
| 6092 | C -> A | Yes |
| 6369 | C -> G | Yes |
| 6436 | A -> | No |
| 6460 | A -> | No |
| 6538 | A -> G | Yes |
| 6718 | C -> T | Yes |
| 6837 | T -> G | Yes |

Variant protein HUMTEN_PEA_1_P26 (SEQ ID NO: 946) according to the present invention has an amino acid sequence as given at the end of the application; it is encoded by transcript(s) HUMTEN_PEA_1_T32 (SEQ ID NO: 869). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P26 (SEQ ID NO: 946) and TENA_HUMAN_V1:

1. An isolated chimeric polypeptide encoding for HUMTEN_PEA_1_P26 (SEQ ID NO: 946), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTRLDAPSQIEVKDVT DTTALITWFKPLAEIDGIELTYGIKD-VPGDRTTIDLTEDENQYSIGNLKPDTEYEVSLISRR GDMSSNPAKETFTTGLDAPRNLR-RVSQTDNSITLEWRNGKAAIDSYRIKYAPISGGDHA EVDVPKSQQATTKTTLTGLRPGTEY-GIGVSAVKEDKESNPATINAATELDTPKDLQVSE TAETSLTLLWKTPLAKFDRYRLNYSLPT-GQWVGVQLPRNTTSYVLRGLEPGQEYNVLL TAEKGRHKSKPARVKASTEQAPELEN-LTVTEVGWDGLRLNWTAADQAYEHFIIQVQE ANKVEAARNLTVPGSLRAVDIPGLKAAT- PYTVSIYGVIQGYRTPVLSAEASTGETPNLG EVV-
VAEVGWDALKLNWTAPEGAYEY-
FFIQVQEADTVEAAQNLTVPGGLRSTDLPGLK
AATHYTITIRGVTQDFSTTPLSVEVL-
TEEVPDMGNLTVTEVSWDALRLNWTTPDGTYD QFT-
IQVQEADQVEEAHNLTVPGSLRS-
MEIPGLRAGTPYTVTLHGEVRGHSTRPLAVEVV
TEDLPQLGDLAVSEVGWDGLRLNWTAAD-
NAYEHFVIQVQEVNKVEAAQNLTLPGSLR
AVDIPGLEAATPYRVSIYGVIRGYRTPV-
LSAEASTAKEPEIGNLNVSDITPESFNLSWMA TDG-
IFETFTIEIIDSNRLLETVEYNISGAER-
TAHISGLPPSTDFIVYLSGLAPSIRTKTISATA
TTEALPLLENLTISDINPYGFTVSW-
MASENAFDSFLVTVVDSGKLLDPQEFTLSGTQRKL
ELRGLITGIGYEVMVSGFTQGHQTKPL-
RAEIVTEAEPEVDNLLVSDATPDGFRLSWTAD
EGVFDNFVLKIRDTKKQSEPLEITLLAP-
ERTRDLTGLREATEYEIELYGISKGRRSQTVSA IATT
corresponding to amino acids 1-1708 of TENA_HU-
MAN_V1, which also corresponds to amino acids 1-1708 of
HUMTEN_PEA__1_P26 (SEQ ID NO: 946), and a second
amino acid sequence being at least 70%, optionally at least
80%, preferably at least 85%, more preferably at least 90%
and most preferably at least 95% homologous to a polypep-
tide having the sequence GTVNKQERTEKSHDSGVFF-
SQG (SEQ ID NO: 1103) corresponding to amino acids
1709-1730 of HUMTEN_PEA__1_P26 (SEQ ID NO: 946),
wherein said first amino acid sequence and second amino acid
sequence are contiguous and in a sequential order.

2. An isolated polypeptide encoding for a tail of
HUMTEN_PEA__1_P26 (SEQ ID NO: 946), comprising a
polypeptide being at least 70%, optionally at least about 80%,
preferably at least about 85%, more preferably at least about
90% and most preferably at least about 95% homologous to
the sequence GTVNKQERTEKSHDSGVFFSQG (SEQ ID
NO: 1103) in HUMTEN_PEA__1_P26 (SEQ ID NO: 946).

It should be noted that the known protein sequence (TEN-
A_HUMAN) has one or more changes than the sequence
given at the end of the application and named as being the
amino acid sequence for TENA_HUMAN_V1. These
changes were previously known to occur and are listed in the
table below.

TABLE 43

Changes to TENA__HUMAN__V1

| SNP position(s) on amino acid sequence | Type of change |
|---|---|
| 371 | conflict |
| 540 | conflict |

The location of the variant protein was determined accord-
ing to results from a number of different software programs
and analyses, including analyses from SignalP and other spe-
cialized programs. The variant protein is believed to be
located as follows with regard to the cell: secreted. The pro-
tein localization is believed to be secreted because both sig-
nal-peptide prediction programs predict that this protein has a
signal peptide, and neither trans-membrane region prediction
program predicts that this protein has a trans-membrane
region.

Variant protein HUMTEN_PEA__1_P26 (SEQ ID NO:
946) also has the following non-silent SNPs (Single Nucle-
otide Polymorphisms) as listed in Table 44, (given according
to their position(s) on the amino acid sequence, with the
alternative amino acid(s) listed; the last column indicates
whether the SNP is known or not; the presence of known
SNPs in variant protein HUMTEN_PEA__1_P26 (SEQ ID
NO: 946) sequence provides support for the deduced
sequence of this variant protein according to the present
invention).

TABLE 44

Amino acid mutations

| SNP position(s) on amino acid sequence | Alternative amino acid(s) | Previously known SNP? |
|---|---|---|
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 1066 | R -> H | No |
| 1677 | L -> I | Yes |

Variant protein HUMTEN_PEA__1_P26 (SEQ ID NO:
946) is encoded by the following transcript(s): HUMTEN_
PEA__1_T32 (SEQ ID NO: 869), for which the sequence(s)
is/are given at the end of the application. The coding portion
of transcript HUMTEN_PEA__1_T32 (SEQ ID NO: 869) is
shown in bold; this coding portion starts at position 348 and
ends at position 5537. The transcript also has the following
SNPs as listed in Table 45 (given according to their position
on the nucleotide sequence, with the alternative nucleic acid
listed; the last column indicates whether the SNP is known or
not; the presence of known SNPs in variant protein
HUMTEN_PEA__1_P26 (SEQ ID NO: 946) sequence pro-
vides support for the deduced sequence of this variant protein
according to the present invention).

TABLE 45

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |
| 3512 | C -> T | Yes |
| 3544 | G -> A | No |
| 3635 | A -> G | Yes |
| 4922 | G -> A | No |
| 5376 | T -> A | Yes |
| 5673 | G -> A | Yes |

TABLE 45-continued

Nucleic acid SNPs

| SNP position on nucleotide sequence | Alternative nucleic acid | Previously known SNP? |
|---|---|---|
| 6041 | G -> C | Yes |
| 6081 | C -> T | Yes |
| 6101 | C -> T | Yes |
| 6318 | G -> A | Yes |

Variant protein HUMTEN_PEA_1_P27 (SEQ ID NO: 947) according to the present invention has an amino acid sequence as given at the end of the application; it is encoded by transcript(s) HUMTEN_PEA_1_T35 (SEQ ID NO: 870). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P27 (SEQ ID NO: 947) and TENA_HUMAN_V1:

1. An isolated chimeric polypeptide encoding for HUMTEN_PEA_1_P27 (SEQ ID NO: 947), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRNIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTRLDAPSQIEVKDVT DTTALITWFKPLAEIDGIELTYGIKD-VPGDRTTIDLTEDENQYSIGNLKPDTEYEVSLISRR GDMSSNPAKETFTTGLDAPRNLR-RVSQTDNSITLEWRNGKAAIDSYRIKYAPISGGDHA EVDVPKSQQATTKTTLTGLRPGTEY-GIGVSAVKEDKESNPATINAATELDTPKDLQVSE TAETSLTLLWKTPLAKFDRYRLNYSLPT-GQWVGVQLPRNTTSYVLRGLEPGQEYNVLL TAEKGRHKSKPARVKASTEQAPELEN-LTVTEVGWDGLRLNWTAADQAYEHFIIQVQE ANKVEAARNLTVPGSLRAVDIPGLKAAT-PYTVSIYGVIQGYRTPVLSAEASTGETPNLG EVV-VAEVGWDALKLNWTAPEGAYEY-FFIQVQEADTVEAAQNLTVPGGLRSTDLPGLK AATHYTITIRGVTQDFSTTPLSVEVL-TEEVPDMGNLTVTEVSWDALRLNWTTPDGTYD QFT-IQVQEADQVEEAHNLTVPGSLRS-MEIPGLRAGTPYTVTLHGEVRGHSTRPLAVEVV T corresponding to amino acids 1-1344 of TENA_HUMAN_V1, which also corresponds to amino acids 1-1344 of HUMTEN_PEA_1_P27 (SEQ ID NO: 947), and a second amino acid sequence being at least 70%, optionally at least 80%, preferably at least 85%, more preferably at least 90% and most preferably at least 95% homologous to a polypeptide having the sequence GI corresponding to amino acids 1345-1346 of HUMTEN_PEA_1_P27 (SEQ ID NO: 947), wherein said first amino acid sequence and second amino acid sequence are contiguous and in a sequential order.

It should be noted that the known protein sequence (TENA_HUMAN) has one or more changes than the sequence given at the end of the application and named as being the amino acid sequence for TENA_HUMAN_V1. These changes were previously known to occur and are listed in the table below.

TABLE 46

Changes to TENA_HUMAN_V1

| SNP position(s) on amino acid sequence | Type of change |
|---|---|
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTEN_PEA_1_P27 (SEQ ID NO: 947) also has the following non-silent SNPs (Single Nucleotide Polymorphisms) as listed in Table 47, (given according to their position(s) on the amino acid sequence, with the alternative amino acid(s) listed; the last column indicates whether the SNP is known or not; the presence of known SNPs in variant protein HUMTEN_PEA_1_P27 (SEQ ID NO: 947) sequence provides support for the deduced sequence of this variant protein according to the present invention).

TABLE 47

Amino acid mutations

| SNP position(s) on amino acid sequence | Alternative amino acid(s) | Previously known SNP? |
|---|---|---|
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |

TABLE 47-continued

Amino acid mutations

| SNP position(s) on amino acid sequence | Alternative amino acid(s) | Previously known SNP? |
|---|---|---|
| 851 | L -> V | Yes |
| 1066 | R -> H | No |

Variant protein HUMTEN_PEA_1_P27 (SEQ ID NO: 947) is encoded by the following transcript(s): HUMTEN_PEA_1_T35 (SEQ ID NO: 870), for which the sequence(s) is/are given at the end of the application. The coding portion of transcript HUMTEN_PEA_1_T35 (SEQ ID NO: 870) is shown in bold; this coding portion starts at position 348 and ends at position 4385. The transcript also has the following SNPs as listed in Table 48 (given according to their position on the nucleotide sequence, with the alternative nucleic acid listed; the last column indicates whether the SNP is known or not; the presence of known SNPs in variant protein HUMTEN_PEA_1_P27 (SEQ ID NO: 947) sequence provides support for the deduced sequence of this variant protein according to the present invention).

TABLE 48

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |
| 3512 | C -> T | Yes |
| 3544 | G -> A | No |
| 3635 | A -> G | Yes |

Variant protein HUMTEN_PEA_1_P28 (SEQ ID NO: 948) according to the present invention has an amino acid sequence as given at the end of the application; it is encoded by transcript(s) HUMTEN_PEA_1_T36 (SEQ ID NO: 871). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P28 (SEQ ID NO: 948) and TENA_HUMAN_V1:

1. An isolated chimeric polypeptide encoding for HUMTEN_PEA_1_P28 (SEQ ID NO: 948), comprising a first amino acid sequence being at least 90% homologous to MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDC SDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQ CICHEGFTGLDCGQHSCPSDCNNLGQCVSGRCICNEGYSGEDCSEVSPPKDLVVTE VTE ETVNLAWDNEMRVTEYLVVYTPTHEGGLEMQFRVPGDQTSTIIQELEPGVEYFIRVFAI LENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLG EVVVAEVGWDALKLNWTAPEGAYEYFFIQVQEADTVEAAQNLTVPGGLRSTDLPGLKAATHYTITIRGVTQDFSTTPLSVEVLT corresponding to amino acids 1-1253 of TENA_HUMAN_V1, which also corresponds to amino acids 1-1253 of HUMTEN_PEA_1_P28 (SEQ ID NO: 948), and a second amino acid sequence being at least 70%, optionally at least 80%, preferably at least 85%, more preferably at least 90% and most preferably at least 95% homologous to a polypeptide having the sequence GILDEFTNSLPPLCLCSGGIKALSCFKLGSAPTTLGKYQ (SEQ ID NO: 1104) corresponding to amino acids 1254-1292 of HUMTEN_PEA_1_P28 (SEQ ID NO: 948), wherein said first amino acid sequence and second amino acid sequence are contiguous and in a sequential order.

2. An isolated polypeptide encoding for a tail of HUMTEN_PEA_1_P28 (SEQ ID NO: 948), comprising a polypeptide being at least 70%, optionally at least about 80%, preferably at least about 85%, more preferably at least about 90% and most preferably at least about 95% homologous to the sequence GILDEFTNSLPPLCLCSGGIKALSCFKLGSAPTTLGKYQ (SEQ ID NO: 1104) in HUMTEN_PEA_1_P28 (SEQ ID NO: 948).

It should be noted that the known protein sequence (TENA_HUMAN) has one or more changes than the sequence given at the end of the application and named as being the amino acid sequence for TENA_HUMAN_V1. These changes were previously known to occur and are listed in the table below.

TABLE 49

Changes to TENA_HUMAN_V1

| SNP position(s) on amino acid sequence | Type of change |
|---|---|
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTEN_PEA_1_P28 (SEQ ID NO: 948) also has the following non-silent SNPs (Single Nucleotide Polymorphisms) as listed in Table 50, (given according to their position(s) on the amino acid sequence, with the alternative amino acid(s) listed; the last column indicates whether the SNP is known or not; the presence of known SNPs in variant protein HUMTEN_PEA_1_P28 (SEQ ID NO: 948) sequence provides support for the deduced sequence of this variant protein according to the present invention).

TABLE 50

Amino acid mutations

| SNP position(s) on amino acid sequence | Alternative amino acid(s) | Previously known SNP? |
|---|---|---|
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 1066 | R -> H | No |

Variant protein HUMTEN_PEA_1_P28 (SEQ ID NO: 948) is encoded by the following transcript(s): HUMTEN_PEA_1_T36 (SEQ ID NO: 871), for which the sequence(s) is/are given at the end of the application. The coding portion of transcript HUMTEN_PEA_1_T36 (SEQ ID NO: 871) is shown in bold; this coding portion starts at position 348 and ends at position 4223. The transcript also has the following SNPs as listed in Table 51 (given according to their position on the nucleotide sequence, with the alternative nucleic acid listed; the last column indicates whether the SNP is known or not; the presence of known SNPs in variant protein HUMTEN_PEA_1_P28 (SEQ ID NO: 948) sequence provides support for the deduced sequence of this variant protein according to the present invention).

TABLE 51

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |
| 3512 | C -> T | Yes |
| 3544 | G -> A | No |
| 3635 | A -> G | Yes |

Variant protein HUMTEN_PEA_1_P29 (SEQ ID NO: 949) according to the present invention has an amino acid sequence as given at the end of the application; it is encoded by transcript(s) HUMTEN_PEA_1_T37 (SEQ ID NO: 872). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P29 (SEQ ID NO: 949) and TENA_HUMAN_V1:

1. An isolated chimeric polypeptide encoding for HUMTEN_PEA_1_P29 (SEQ ID NO: 949), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN- KKSIPVSARVATYLPAPEGLKFK-
SIKETSVEVEWDPLDIAFETWEIIFRNMNKEDEG
EITKSLRRPETSYRQTGLAPGQEYEISL-
HIVKNNTRGPGLKRVTTTRLDAPSQIEVKDVT
DTTALITWFKPLAEIDGIELTYGIKD-
VPGDRTTIDLTEDENQYSIGNLKPDTEYEVSLISRR
GDMSSNPAKETFTTGLDAPRNLR-
RVSQTDNSITLEWRNGKAAIDSYRIKYAPISGQDHA
EVDVPKSQQATTKTTLTGLRPGTEY-
GIGVSAVKEDKESNPATINAATELDTPKDLQVSE
TAETSLTLLWKTPLAKFDRYRLNYSLPT-
GQWVGVQLPRNTTSYVLRGLEPGQEYNVLL
TAEKGRHKSKPARVKAST corresponding to amino acids 1-1071 of TENA_HUMAN_V1, which also corresponds to amino acids 1-1071 of HUMTEN_PEA__1_P29 (SEQ ID NO: 949), and a second amino acid sequence being at least 70%, optionally at least 80%, preferably at least 85%, more preferably at least 90% and most preferably at least 95% homologous to a polypeptide having the sequence GESALS-FLQTLG (SEQ ID NO: 1105) corresponding to amino acids 1072-1083 of HUMTEN_PEA__1_P29 (SEQ ID NO: 949), wherein said first amino acid sequence and second amino acid sequence are contiguous and in a sequential order.

2. An isolated polypeptide encoding for a tail of HUMTEN_PEA__1_P29 (SEQ ID NO: 949), comprising a polypeptide being at least 70%, optionally at least about 80%, preferably at least about 85%, more preferably at least about 90% and most preferably at least about 95% homologous to the sequence GESALSFLQTLG (SEQ ID NO: 1105) in HUMTEN_PEA__1_P29 (SEQ ID NO: 949).

It should be noted that the known protein sequence (TEN-A_HUMAN) has one or more changes than the sequence given at the end of the application and named as being the amino acid sequence for TENA_HUMAN_V1. These changes were previously known to occur and are listed in the table below.

TABLE 52

Changes to TENA_HUMAN_V1

| SNP position(s) on amino acid sequence | Type of change |
|---|---|
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTEN_PEA__1_P29 (SEQ ID NO: 949) also has the following non-silent SNPs (Single Nucleotide Polymorphisms) as listed in Table 53, (given according to their position(s) on the amino acid sequence, with the alternative amino acid(s) listed; the last column indicates whether the SNP is known or not; the presence of known SNPs in variant protein HUMTEN_PEA__1_P29 (SEQ ID NO: 949) sequence provides support for the deduced sequence of this variant protein according to the present invention).

TABLE 53

Amino acid mutations

| SNP position(s) on amino acid sequence | Alternative amino acid(s) | Previously known SNP? |
|---|---|---|
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 1066 | R -> H | No |

Variant protein HUMTEN_PEA__1_P29 (SEQ ID NO: 949) is encoded by the following transcript(s): HUMTEN_PEA__1_T37 (SEQ ID NO: 872), for which the sequence(s) is/are given at the end of the application. The coding portion of transcript HUMTEN_PEA__1_T37 (SEQ ID NO: 872) is shown in bold; this coding portion starts at position 348 and ends at position 3596. The transcript also has the following SNPs as listed in Table 54 (given according to their position on the nucleotide sequence, with the alternative nucleic acid listed; the last column indicates whether the SNP is known or not; the presence of known SNPs in variant protein HUMTEN_PEA__1_P29 (SEQ ID NO: 949) sequence provides support for the deduced sequence of this variant protein according to the present invention).

TABLE 54

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |
| 3512 | C -> T | Yes |
| 3544 | G -> A | No |
| 3693 | A -> C | Yes |

Variant protein HUMTEN_PEA__1_P30 (SEQ ID NO: 950) according to the present invention has an amino acid sequence as given at the end of the application; it is encoded by transcript(s) HUMTEN_PEA__1_T39 (SEQ ID NO: 873). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P30 (SEQ ID NO: 950) and TENA_HUMAN_V1:

1. An isolated chimeric polypeptide encoding for HUMTEN_PEA_1_P30 (SEQ ID NO: 950), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTRLDAPSQIEVKDVT DTTALITWFKPLAEIDGIELTYGIKD-VPGDRTTIDLTEDENQYSIGNLKPDTEYEVSLISRR GDMSSNPAKETFTTGLDAPRNLR-RVSQTDNSITLEWRNGKAAIDSYRIKYAPISGGDHA EVDVPKSQQATTKTTLTG corresponding to amino acids 1-954 of TENA_HUMAN_V1, which also corresponds to amino acids 1-954 of HUMTEN_PEA_1_P30 (SEQ ID NO: 950), and a second amino acid sequence being at least 70%, optionally at least 80%, preferably at least 85%, more preferably at least 90% and most preferably at least 95% homologous to a polypeptide having the sequence ELCISASLSQ-PALEGP (SEQ ID NO: 1106) corresponding to amino acids 955-970 of HUMTEN_PEA_1_P30 (SEQ ID NO: 950), wherein said first amino acid sequence and second amino acid sequence are contiguous and in a sequential order.

2. An isolated polypeptide encoding for a tail of HUMTEN_PEA_1_P30 (SEQ ID NO: 950), comprising a polypeptide being at least 70%, optionally at least about 80%, preferably at least about 85%, more preferably at least about 90% and most preferably at least about 95% homologous to the sequence ELCISASLSQPALEGP (SEQ ID NO: 1106) in HUMTEN_PEA_1_P30 (SEQ ID NO: 950).

It should be noted that the known protein sequence (TEN-A_HUMAN) has one or more changes than the sequence given at the end of the application and named as being the amino acid sequence for TENA_HUMAN_V1. These changes were previously known to occur and are listed in the table below.

TABLE 55

| Changes to TENA_HUMAN_V1 | |
| --- | --- |
| SNP position(s) on amine acid sequence | Type ef change |
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMTEN_PEA_1_P30 (SEQ ID NO: 950) also has the following non-silent SNPs (Single Nucleotide Polymorphisms) as listed in Table 56, (given according to their position(s) on the amino acid sequence, with the alternative amino acid(s) listed; the last column indicates whether the SNP is known or not; the presence of known SNPs in variant protein HUMTEN_PEA_1_P30 (SEQ ID NO: 950) sequence provides support for the deduced sequence of this variant protein according to the present invention).

TABLE 56

| Amino acid mutations | | |
| --- | --- | --- |
| SNP position(s) on amino acid sequence | Alternative amino acid(s) | Previously known SNP? |
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |
| 842 | V -> L | No |
| 850 | D -> H | Yes |
| 851 | L -> V | Yes |
| 969 | G -> R | Yes |

Variant protein HUMTEN_PEA_1_P30 (SEQ ID NO: 950) is encoded by the following transcript(s): HUMTEN_PEA_1_T39 (SEQ ID NO: 873), for which the sequence(s) is/are given at the end of the application. The coding portion of transcript HUMTEN_PEA_1_T39 (SEQ ID NO: 873) is shown in bold; this coding portion starts at position 348 and ends at position 3257. The transcript also has the following SNPs as listed in Table 57 (given according to their position on the nucleotide sequence, with the alternative nucleic acid listed; the last column indicates whether the SNP is known or not; the presence of known SNPs in variant protein HUMTEN_PEA_1_P30 (SEQ ID NO: 950) sequence provides support for the deduced sequence of this variant protein according to the present invention).

TABLE 57

Nucleic acid SNPs

| SNP position on nucleotide sequence | Alternative nucleic acid | Previously known SNP? |
| --- | --- | --- |
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |
| 2871 | G -> T | No |
| 2895 | G -> C | Yes |
| 2898 | C -> G | Yes |
| 3005 | A -> G | No |
| 3252 | G -> C | Yes |

Variant protein HUMTEN_PEA_1_P31 (SEQ ID NO: 951) according to the present invention has an amino acid sequence as given at the end of the application; it is encoded by transcript(s) HUMTEN_PEA_1_T40 (SEQ ID NO: 874). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P31 (SEQ ID NO: 951) and TENA_HUMAN_V1:

1. An isolated chimeric polypeptide encoding for HUMTEN_PEA_1_P31 (SEQ ID NO: 951), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVATYLPAPEGLKFK-SIKETSVEVEWDPLDIAFETWEIIFRNMNKEDEG EITKSLRRPETSYRQTGLAPGQEYEISL-HIVKNNTRGPGLKRVTTTR corresponding to amino acids 1-802 of TENA_HUMAN_V1, which also corresponds to amino acids 1-802 of HUMTEN_PEA_1_P31 (SEQ ID NO: 951), and a second amino acid sequence being at least 70%, optionally at least 80%, preferably at least 85%, more preferably at least 90% and most preferably at least 95% homologous to a polypeptide having the sequence EYHL (SEQ ID NO: 1107) corresponding to amino acids 803-806 of HUMTEN_PEA_1_P31 (SEQ ID NO: 951), wherein said first amino acid sequence and second amino acid sequence are contiguous and in a sequential order.

2. An isolated polypeptide encoding for a tail of HUMTEN_PEA_1_P31 (SEQ ID NO: 951), comprising a polypeptide being at least 70%, optionally at least about 80%, preferably at least about 85%, more preferably at least about 90% and most preferably at least about 95% homologous to the sequence EYHL (SEQ ID NO: 1107) in HUMTEN_PEA_1_P31 (SEQ ID NO: 951).

It should be noted that the known protein sequence (TEN-A_HUMAN) has one or more changes than the sequence given at the end of the application and named as being the amino acid sequence for TENA_HUMAN_V1. These changes were previously known to occur and are listed in the table below.

TABLE 58

Changes to TENA_HUMAN_V1

| SNP position(s) on amino acid sequence | Type of change |
| --- | --- |
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTEN_PEA_1_P31 (SEQ ID NO: 951) also has the following non-silent SNPs (Single Nucleotide Polymorphisms) as listed in Table 59, (given according to their position(s) on the amino acid sequence, with the alternative amino acid(s) listed; the last column indicates whether the SNP is known or not; the presence of known SNPs in variant protein HUMTEN_PEA_1_P31 (SEQ ID NO: 951) sequence provides support for the deduced sequence of this variant protein according to the present invention).

TABLE 59

Amino acid mutations

| SNP position(s) on amino acid sequence | Alternative amino acid(s) | Previously known SNP? |
| --- | --- | --- |
| 149 | Q -> * | No |
| 213 | G -> S | Yes |
| 370 | V -> L | Yes |
| 539 | R -> Q | Yes |

TABLE 59-continued

Amino acid mutations

| SNP position(s) on amino acid sequence | Alternative amino acid(s) | Previously known SNP? |
|---|---|---|
| 605 | V -> I | Yes |
| 680 | Q -> R | Yes |

Variant protein HUMTEN_PEA_1_P31 (SEQ ID NO: 951) is encoded by the following transcript(s): HUMTEN_PEA_1_T40 (SEQ ID NO: 874), for which the sequence(s) is/are given at the end of the application. The coding portion of transcript HUMTEN_PEA_1_T40 (SEQ ID NO: 874) is shown in bold; this coding portion starts at position 348 and ends at position 2765. The transcript also has the following SNPs as listed in Table 60 (given according to their position on the nucleotide sequence, with the alternative nucleic acid listed; the last column indicates whether the SNP is known or not; the presence of known SNPs in variant protein HUMTEN_PEA_1_P31 (SEQ ID NO: 951) sequence provides support for the deduced sequence of this variant protein according to the present invention).

TABLE 60

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2654 | G -> A | No |

Variant protein HUMTEN_PEA_1_P32 (SEQ ID NO: 952) according to the present invention has an amino acid sequence as given at the end of the application; it is encoded by transcript(s) HUMTEN_PEA_1_T41 (SEQ ID NO: 875). An alignment is given to the known protein (Tenascin precursor) at the end of the application. One or more alignments to one or more previously published protein sequences are given at the end of the application. A brief description of the relationship of the variant protein according to the present invention to each such aligned protein is as follows:

Comparison report between HUMTEN_PEA_1_P32 (SEQ ID NO: 952) and TENA_HUMAN_V1:

1. An isolated chimeric polypeptide encoding for HUMTEN_PEA_1_P32 (SEQ ID NO: 952), comprising a first amino acid sequence being at least 90% homologous to MGAMTQLLAGVFLAFLALATEGGV-LKKVIRHKRQSGVNATLPEENQPVVFNHVYNIK LPVGSQCSVDLESASGEKDLAPPSEPS-ESFQEHTVDGENQIVFTHRINIPRRACGCAAAP DVKELLSRLEELENLVSSLREQCTA-GAGCCLQPATGRLDTRPFCSGRGNFSTEGCGCVC EPGWKGPNCSEPECPGNCHLRGR-CIDGQCICDDGFTGEDCSQLACPSDCNDQGKCVNG VCICFEGYAGADCSREICPVPCSEEH-GTCVDGLCVCHDGFAGDDCNKPLCLNNCYNRG RCVENECVCDEGFTGEDCSELICPND-CFDRGRCINGTCYCEEGFTGEDCGKPTCPHACH TQGRCEEGQCVCDEGFAGVDCSEKRC-PADCHNRGRCVDGRCECDDGFTGADCGELKC PNGCSGHGRCVNGQCVCDEGYTGEDC-SQLRCPNDCHSRGRCVEGKCVCEQGFKGYDC SDM-SCPNDCHQHGRCVNGMCVCDDGYTGED-CRDRQCPRDCSNRGLCVDGQCVCEDG FTGPDCAELSCPNDCHGR-GRCVNGQCVCHEGFMGKDCKEQRCPSD-CHGQGRCVDGQ CICHEGFTGLDCGQHSCPSD-CNNLGQCVSGRCICNEGYSGEDCSEVSPPKDLVVTE VTE ETVNLAWDNEMRVTEYLVVYTPTHEG-GLEMQFRVPGDQTSTIIQELEPGVEYFIRVFAI LEN-KKSIPVSARVAT corresponding to amino acids 1-710 of TENA_HUMAN_V1, which also corresponds to amino acids 1-710 of HUMTEN_PEA_1_P32 (SEQ ID NO: 952), and a second amino acid sequence being at least 70%, optionally at least 80%, preferably at least 85%, more preferably at least 90% and most preferably at least 95% homologous to a polypeptide having the sequence CE corresponding to amino acids 711-712 of HUMTEN_PEA_1_P32 (SEQ ID NO: 952), wherein said first amino acid sequence and second amino acid sequence are contiguous and in a sequential order.

It should be noted that the known protein sequence (TENA_HUMAN) has one or more changes than the sequence given at the end of the application and named as being the amino acid sequence for TENA_HUMAN_V1. These changes were previously known to occur and are listed in the table below.

TABLE 61

Changes to TENA_HUMAN_V1

| SNP position(s) on amino acid sequence | Type of change |
|---|---|
| 371 | conflict |
| 540 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTEN_PEA_1_P32 (SEQ ID NO: 952) also has the following non-silent SNPs (Single Nucleotide Polymorphisms) as listed in Table 62, (given according to their position(s) on the amino acid sequence, with the alternative amino acid(s) listed; the last column indicates whether the SNP is known or not; the presence of known SNPs in variant protein HUMTEN_PEA_1_P32 (SEQ ID NO: 952) sequence provides support for the deduced sequence of this variant protein according to the present invention).

TABLE 62

Amino acid mutations

| SNP position(s) on amino acid sequence | Alternative amino acid(s) | Previously known SNP? |
|---|---|---|
| 149 | Q -> * | No |
| 213 | G -> S | Yes |
| 370 | V -> L | Yes |
| 539 | R -> Q | Yes |
| 605 | V -> I | Yes |
| 680 | Q -> R | Yes |

Variant protein HUMTEN_PEA_1_P32 (SEQ ID NO: 952) is encoded by the following transcript(s): HUMTEN_PEA_1_T41 (SEQ ID NO: 875), for which the sequence(s) is/are given at the end of the application. The coding portion of transcript HUMTEN_PEA_1_T41 (SEQ ID NO: 875) is shown in bold; this coding portion starts at position 348 and ends at position 2483. The transcript also has the following SNPs as listed in Table 63 (given according to their position on the nucleotide sequence, with the alternative nucleic acid listed; the last column indicates whether the SNP is known or not; the presence of known SNPs in variant protein HUMTEN_PEA_1_P32 (SEQ ID NO: 952) sequence provides support for the deduced sequence of this variant protein according to the present invention).

TABLE 63

Nucleic acid SNPs

| SNP position on nucleotide sequence | Alternative nucleic acid | Previously known SNP? |
|---|---|---|
| 115 | T -> G | Yes |
| 123 | A -> G | Yes |
| 315 | C -> T | Yes |
| 434 | C -> T | Yes |
| 503 | C -> T | Yes |
| 542 | G -> A | Yes |
| 623 | A -> G | Yes |
| 792 | C -> T | No |
| 984 | G -> A | Yes |
| 1043 | A -> G | Yes |
| 1455 | G -> T | Yes |
| 1963 | G -> A | Yes |
| 2156 | A -> G | Yes |
| 2160 | G -> A | Yes |
| 2386 | A -> G | Yes |
| 2396 | A -> G | Yes |
| 2516 | T -> C | Yes |
| 2531 | C -> T | No |
| 2850 | G -> A | Yes |
| 2886 | G -> A | Yes |

As noted above, cluster HUMTEN features 57 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMTEN_PEA_1_node_0 (SEQ ID NO: 876) according to the present invention is supported by 15 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858) HUMTEN_PEA_1_T5 (SEQ ID NO: 858) (SEQ ID NO: 859), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867), HUMTEN_PEA_1_T23 (SEQ ID NO: 868), HUMTEN_PEA_1_T32 (SEQ ID NO: 869), HUMTEN_PEA_1_T35 (SEQ ID NO: 870), HUMTEN_PEA_1_T36 (SEQ ID NO: 871), HUMTEN_PEA_1_T37 (SEQ ID NO: 872), HUMTEN_PEA_1_T39 (SEQ ID NO: 873), HUMTEN_PEA_1_T40 (SEQ ID NO: 874) and HUMTEN_PEA_1_T41 (SEQ ID NO: 875). Table 64 below describes the starting and ending position of this segment on each transcript.

TABLE 64

Segment location on transcripts

| Transcript name | Segment starting position | Segment ending position |
|---|---|---|
| HUMTEN_PEA_1_T4 (SEQ ID NO: 857) | 1 | 211 |
| HUMTEN_PEA_1_T5 (SEQ ID NO: 858) | 1 | 211 |
| HUMTEN_PEA_1_T5 (SEQ ID NO: 858) (SEQ ID NO: 859) | | |
| HUMTEN_PEA_1_T6 (SEQ ID NO: 859) | 1 | 211 |
| HUMTEN_PEA_1_T7 (SEQ ID NO: 860) | 1 | 211 |
| HUMTEN_PEA_1_T11 (SEQ ID NO: 861) | 1 | 211 |
| HUMTEN_PEA_1_T14 (SEQ ID NO: 862) | 1 | 211 |
| HUMTEN_PEA_1_T16 (SEQ ID NO: 863) | 1 | 211 |
| HUMTEN_PEA_1_T17 (SEQ ID NO: 864) | 1 | 211 |
| HUMTEN_PEA_1_T18 (SEQ ID NO: 865) | 1 | 211 |
| HUMTEN_PEA_1_T19 (SEQ ID NO: 866) | 1 | 211 |
| HUMTEN_PEA_1_T20 (SEQ ID NO. 867) | 1 | 211 |
| HUMTEN_PEA_1_T23 (SEQ ID NO: 868) | 1 | 211 |
| HUMTEN_PEA_1_T32 (SEQ ID NO: 869) | 1 | 211 |
| HUMTEN_PEA_1_T35 (SEQ ID NO: 870) | 1 | 211 |
| HUMTEN_PEA_1_T36 (SEQ ID NO: 871) | 1 | 211 |
| HUMTEN_PEA_1_T37 (SEQ ID NO: 872) | 1 | 211 |
| HUMTEN_PEA_1_T39 (SEQ ID NO: 873) | 1 | 211 |
| HUMTEN_PEA_1_T40 (SEQ ID NO: 874) | 1 | 211 |
| HUMTEN_PEA_1_T41 (SEQ ID NO: 875) | 1 | 211 |

Segment cluster HUMTEN_PEA_1_node_2 (SEQ ID NO: 877) according to the present invention is supported by 25 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858) HUMTEN_PEA_1_T5 (SEQ ID NO: 858) (SEQ ID NO: 859), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867), HUMTEN_PEA_1_T23 (SEQ ID NO: 868), HUMTEN_PEA_1_T32 (SEQ ID NO: 869), HUMTEN_PEA_1_T35 (SEQ ID NO: 870), HUMTEN_PEA_1_T36 (SEQ ID NO: 871), HUMTEN_PEA_1_T37 (SEQ ID NO: 872), HUMTEN_PEA_1_T39 (SEQ ID NO: 873), HUMTEN_PEA_1_T40 (SEQ ID NO: 874) and HUMTEN_PEA_1_T41 (SEQ ID NO: 875). Table 65 below describes the starting and ending position of this segment on each transcript.

TABLE 65

Segment location on transcripts

| Transcript name | Segment starting position | Segment ending position |
|---|---|---|
| HUMTEN_PEA_1_T4 (SEQ ID NO: 857) | 212 | 804 |
| HUMTEN_PEA_1_T5 (SEQ ID NO: 858) | 212 | 804 |
| HUMTEN_PEA_1_T5 (SEQ ID NO: 858) (SEQ ID NO: 859) | | |
| HUMTEN_PEA_1_T6 (SEQ ID NO: 859) | 212 | 804 |
| HUMTEN_PEA_1_T7 (SEQ ID NO: 860) | 212 | 804 |
| HUMTEN_PEA_1_T11 (SEQ ID NO: 861) | 212 | 804 |
| HUMTEN_PEA_1_T14 (SEQ ID NO: 862) | 212 | 804 |
| HUMTEN_PEA_1_T16 (SEQ ID NO: 863) | 212 | 804 |
| HUMTEN_PEA_1_T17 (SEQ ID NO: 864) | 212 | 804 |
| HUMTEN_PEA_1_T18 (SEQ ID NO: 865) | 212 | 804 |
| HUMTEN_PEA_1_T19 (SEQ ID NO: 866) | 212 | 804 |
| HUMTEN_PEA_1_T20 (SEQ ID NO. 867) | 212 | 804 |
| HUMTEN_PEA_1_T23 (SEQ ID NO: 868) | 212 | 804 |
| HUMTEN_PEA_1_T32 (SEQ ID NO: 869) | 212 | 804 |
| HUMTEN_PEA_1_T35 (SEQ ID NO: 870) | 212 | 804 |
| HUMTEN_PEA_1_T36 (SEQ ID NO: 871) | 212 | 804 |
| HUMTEN_PEA_1_T37 (SEQ ID NO: 872) | 212 | 804 |
| HUMTEN_PEA_1_T39 (SEQ ID NO: 873) | 212 | 804 |
| HUMTEN_PEA_1_T40 (SEQ ID NO: 874) | 212 | 804 |
| HUMTEN_PEA_1_T41 (SEQ ID NO: 875) | 212 | 804 |

Segment cluster HUMTEN_PEA_1_node_5 (SEQ ID NO: 878) according to the present invention is supported by 34 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858) HUMTEN_PEA_1_T5 (SEQ ID NO: 858) (SEQ ID NO: 859), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867), HUMTEN_PEA_1_T23 (SEQ ID NO: 868), HUMTEN_PEA_1_T32 (SEQ ID NO: 869), HUMTEN_PEA_1_T35 (SEQ ID NO: 870), HUMTEN_PEA_1_T36 (SEQ ID NO: 871), HUMTEN_PEA_1_T37 (SEQ ID NO: 872), HUMTEN_PEA_1_T39 (SEQ ID NO: 873), HUMTEN_PEA_1_T40 (SEQ ID NO: 874) and HUMTEN_PEA_1_T41 (SEQ ID NO: 875). Table 66 below describes the starting and ending position of this segment on each transcript.

TABLE 66

Segment location on transcripts

| Transcript name | Segment starting position | Segment ending position |
|---|---|---|
| HUMTEN_PEA_1_T4 (SEQ ID NO: 857) | 805 | 1672 |
| HUMTEN_PEA_1_T5 (SEQ ID NO: 858) | 805 | 1672 |
| HUMTEN_PEA_1_T5 (SEQ ID NO: 859) | | |
| HUMTEN_PEA_1_T6 (SEQ ID NO: 859) | 805 | 1672 |
| HUMTEN_PEA_1_T7 (SEQ ID NO: 860) | 805 | 1672 |
| HUMTEN_PEA_1_T11 (SEQ ID NO: 861) | 805 | 1672 |
| HUMTEN_PEA_1_T14 (SEQ ID NO: 862) | 805 | 1672 |
| HUMTEN_PEA_1_T16 (SEQ ID NO: 863) | 805 | 1672 |
| HUMTEN_PEA_1_T17 (SEQ ID NO: 864) | 805 | 1672 |
| HUMTEN_PEA_1_T18 (SEQ ID NO: 865) | 805 | 1672 |
| HUMTEN_PEA_1_T19 (SEQ ID NO: 866) | 805 | 1672 |
| HUMTEN_PEA_1_T20 (SEQ ID NO. 867) | 805 | 1672 |
| HUMTEN_PEA_1_T23 (SEQ ID NO: 868) | 805 | 1672 |
| HUMTEN_PEA_1_T32 (SEQ ID NO: 869) | 805 | 1672 |
| HUMTEN_PEA_1_T35 (SEQ ID NO: 870) | 805 | 1672 |
| HUMTEN_PEA_1_T36 (SEQ ID NO: 871) | 805 | 1672 |
| HUMTEN_PEA_1_T37 (SEQ ID NO: 872) | 805 | 1672 |
| HUMTEN_PEA_1_T39 (SEQ ID NO: 873) | 805 | 1672 |
| HUMTEN_PEA_1_T40 (SEQ ID NO: 874) | 805 | 1672 |
| HUMTEN_PEA_1_T41 (SEQ ID NO: 875) | 805 | 1672 |

Segment cluster HUMTEN_PEA_1_node_6 (SEQ ID NO: 879) according to the present invention is supported by 21 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858) HUMTEN_PEA_1_T5 (SEQ ID NO: 858) (SEQ ID NO: 859), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867), HUMTEN_PEA_1_T23 (SEQ ID NO: 868), HUMTEN_PEA_1_T32 (SEQ ID NO: 869), HUMTEN_PEA_1_T35 (SEQ ID NO: 870), HUMTEN_PEA_1_T36

(SEQ ID NO: 871), HUMTEN_PEA_1_T37 (SEQ ID NO: 872), HUMTEN_PEA_1_T39 (SEQ ID NO: 873), HUMTEN_PEA_1_T40 (SEQ ID NO: 874) and HUMTEN_PEA_1_T41 (SEQ ID NO: 875). Table 67 below describes the starting and ending position of this segment on each transcript.

TABLE 67

Segment location on transcripts

| Transcript name | Segment starting position | Segment ending position |
|---|---|---|
| HUMTEN_PEA_1_T4 (SEQ ID NO: 857) | 1673 | 1925 |
| HUMTEN_PEA_1_T5 (SEQ ID NO: 858) | 1673 | 1925 |
| HUMTEN_PEA_1_T5 (SEQ ID NO: 858) (SEQ ID NO: 859) | | |
| HUMTEN_PEA_1_T6 (SEQ ID NO: 859) | 1673 | 1925 |
| HUMTEN_PEA_1_T7 (SEQ ID NO: 860) | 1673 | 1925 |
| HUMTEN_PEA_1_T11 (SEQ ID NO: 861) | 1673 | 1925 |
| HUMTEN_PEA_1_T14 (SEQ ID NO: 862) | 1673 | 1925 |
| HUMTEN_PEA_1_T16 (SEQ ID NO: 863) | 1673 | 1925 |
| HUMTEN_PEA_1_T17 (SEQ ID NO: 864) | 1673 | 1925 |
| HUMTEN_PEA_1_T18 (SEQ ID NO: 865) | 1673 | 1925 |
| HUMTEN_PEA_1_T19 (SEQ ID NO: 866) | 1673 | 1925 |
| HUMTEN_PEA_1_T20 (SEQ ID NO: 867) | 1673 | 1925 |
| HUMTEN_PEA_1_T23 (SEQ ID NO: 868) | 1673 | 1925 |
| HUMTEN_PEA_1_T32 (SEQ ID NO: 869) | 1673 | 1925 |
| HUMTEN_PEA_1_T35 (SEQ ID NO: 870) | 1673 | 1925 |
| HUMTEN_PEA_1_T36 (SEQ ID NO: 871) | 1673 | 1925 |
| HUMTEN_PEA_1_T37 (SEQ ID NO: 872) | 1673 | 1925 |
| HUMTEN_PEA_1_T39 (SEQ ID NO: 873) | 1673 | 1925 |
| HUMTEN_PEA_1_T40 (SEQ ID NO: 874) | 1673 | 1925 |
| HUMTEN_PEA_1_T41 (SEQ ID NO: 875) | 1673 | 1925 |

Segment cluster HUMTEN_PEA_1_node_11 (SEQ ID NO: 880) according to the present invention is supported by 34 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858) HUMTEN_PEA_1_T5 (SEQ ID NO: 858) (SEQ ID NO: 859), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO: 867), HUMTEN_PEA_1_T23 (SEQ ID NO: 868), HUMTEN_PEA_1_T32 (SEQ ID NO: 869), HUMTEN_PEA_1_T35 (SEQ ID NO: 870), HUMTEN_PEA_1_T36 (SEQ ID NO: 871), HUMTEN_PEA_1_T37 (SEQ ID NO: 872), HUMTEN_PEA_1_T39 (SEQ ID NO: 873), HUMTEN_PEA_1_T40 (SEQ ID NO: 874) and HUMTEN_PEA_1_T41 (SEQ ID NO: 875). Table 68 below describes the starting and ending position of this segment on each transcript.

TABLE 68

Segment location on transcripts

| Transcript name | Segment starting position | Segment ending position |
|---|---|---|
| HUMTEN_PEA_1_T4 (SEQ ID NO:857) | 2215 | 2478 |
| HUMTEN_PEA_1_T5 (SEQ ID NO:858) | 2215 | 2478 |
| HUMTEN_PEA_1_T5 (SEQ ID NO:858) (SEQ ID NO:859) | | |
| HUMTEN_PEA_1_T6 (SEQ ID NO:859) | 2215 | 2478 |
| HUMTEN_PEA_1_T7 (SEQ ID NO:860) | 2215 | 2478 |
| HUMTEN_PEA_1_T11 (SEQ ID NO:861) | 2215 | 2478 |
| HUMTEN_PEA_1_T14 (SEQ ID NO:862) | 2215 | 2478 |
| HUMTEN_PEA_1_T16 (SEQ ID NO:863) | 2215 | 2478 |
| HUMTEN_PEA_1_T17 (SEQ ID NO:864) | 2215 | 2478 |
| HUMTEN_PEA_1_T18 (SEQ ID NO:865) | 2215 | 2478 |
| HUMTEN_PEA_1_T19 (SEQ ID NO:866) | 2215 | 2478 |
| HUMTEN_PEA_1_T20 (SEQ ID NO:867) | 2215 | 2478 |
| HUMTEN_PEA_1_T23 (SEQ ID NO:868) | 2215 | 2478 |
| HUMTEN_PEA_1_T32 (SEQ ID NO:869) | 2215 | 2478 |
| HUMTEN_PEA_1_T35 (SEQ ID NO:870) | 2215 | 2478 |
| HUMTEN_PEA_1_T36 (SEQ ID NO:871) | 2215 | 2478 |
| HUMTEN_PEA_1_T37 (SEQ ID NO:872) | 2215 | 2478 |
| HUMTEN_PEA_1_T39 (SEQ ID NO:873) | 2215 | 2478 |
| HUMTEN_PEA_1_T40 (SEQ ID NO:874) | 2215 | 2478 |
| HUMTEN_PEA_1_T41 (SEQ ID NO:875) | 2215 | 2478 |

Segment cluster HUMTEN_PEA_1_node_12 (SEQ ID NO: 881) according to the present invention is supported by 2 libraries. The number of libraries was determined as previously described. This segment can be found in the following transcript(s): HUMTEN_PEA_1_T41 (SEQ ID NO: 875). Table 69 below describes the starting and ending position of this segment on each transcript.

TABLE 69

Segment location on transcripts

| Transcript name | Segment starting position | Segment ending position |
|---|---|---|
| HUMTEN_PEA_1_T41 (SEQ ID NO:875) | 2479 | 3027 |

Segment cluster HUMTEN_PEA_1_node_16 (SEQ ID NO: 882) according to the present invention is supported by 27 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858) HUMTEN_PEA_1_T5 (SEQ ID NO: 858) (SEQ ID NO: 859), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO: 867), HUMTEN_PEA_1_T23 (SEQ ID NO: 868), HUMTEN_PEA_1_T32 (SEQ ID NO: 869), HUMTEN_PEA_1_T35 (SEQ ID NO: 870), HUMTEN_PEA_1_T36 (SEQ ID NO: 871), HUMTEN_PEA_1_T37 (SEQ ID NO: 872), HUMTEN_PEA_1_T39 (SEQ ID NO: 873) and HUMTEN_PEA_1_T40 (SEQ ID NO: 874). Table 70 below describes the starting and ending position of this segment on each transcript.

TABLE 70

Segment location on transcripts

| Transcript name | Segment starting position | Segment ending position |
|---|---|---|
| HUMTEN_PEA_1_T4 (SEQ ID NO:857) | 2595 | 2751 |
| HUMTEN_PEA_1_T5 (SEQ ID NO:858) HUMTEN_PEA_1_T5 (SEQ ID NO:858) (SEQ ID NO:859) | 2595 | 2751 |
| HUMTEN_PEA_1_T6 (SEQ ID NO:859) | 2595 | 2751 |
| HUMTEN_PEA_1_T7 (SEQ ID NO:860) | 2595 | 2751 |
| HUMTEN_PEA_1_T11 (SEQ ID NO:861) | 2595 | 2751 |
| HUMTEN_PEA_1_T14 (SEQ ID NO:862) | 2595 | 2751 |
| HUMTEN_PEA_1_T16 (SEQ ID NO:863) | 2595 | 2751 |
| HUMTEN_PEA_1_T17 (SEQ ID NO:864) | 2595 | 2751 |
| HUMTEN_PEA_1_T18 (SEQ ID NO:865) | 2595 | 2751 |
| HUMTEN_PEA_1_T19 (SEQ ID NO:866) | 2595 | 2751 |
| HUMTEN_PEA_1_T20 (SEQ ID NO:867) | 2595 | 2751 |
| HUMTEN_PEA_1_T23 (SEQ ID NO:868) | 2595 | 2751 |
| HUMTEN_PEA_1_T32 (SEQ ID NO:869) | 2595 | 2751 |
| HUMTEN_PEA_1_T35 (SEQ ID NO:870) | 2595 | 2751 |
| HUMTEN_PEA_1_T36 (SEQ ID NO:871) | 2595 | 2751 |
| HUMTEN_PEA_1_T37 (SEQ ID NO:872) | 2595 | 2751 |
| HUMTEN_PEA_1_T39 (SEQ ID NO:873) | 2595 | 2751 |
| HUMTEN_PEA_1_T40 (SEQ ID NO:874) | 2595 | 2751 |

Segment cluster HUMTEN_PEA_1_node_19 (SEQ ID NO: 883) according to the present invention is supported by 29 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858) HUMTEN_PEA_1_T5 (SEQ ID NO: 858) (SEQ ID NO: 859), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO: 867), HUMTEN_PEA_1_T23 (SEQ ID NO: 868), HUMTEN_PEA_1_T32 (SEQ ID NO: 869), HUMTEN_PEA_1_T35 (SEQ ID NO: 870), HUMTEN_PEA_1_T36 (SEQ ID NO: 871), HUMTEN_PEA_1_T37 (SEQ ID NO: 872) and HUMTEN_PEA_1_T39 (SEQ ID NO: 873). Table 71 below describes the starting and ending position of this segment on each transcript.

TABLE 71

Segment location on transcripts

| Transcript name | Segment starting position | Segment ending position |
|---|---|---|
| HUMTEN_PEA_1_T4 (SEQ ID NO:857) | 2752 | 3021 |
| HUMTEN_PEA_1_T5 (SEQ ID NO:858) HUMTEN_PEA_1_T5 (SEQ ID NO:858) (SEQ ID NO:859) | 2752 | 3021 |
| HUMTEN_PEA_1_T6 (SEQ ID NO:859) | 2752 | 3021 |

TABLE 71-continued

Segment location on transcripts

| Transcript name | Segment starting position | Segment ending position |
|---|---|---|
| HUMTEN_PEA_1_T7 (SEQ ID NO:860) | 2752 | 3021 |
| HUMTEN_PEA_1_T11 (SEQ ID NO:861) | 2752 | 3021 |
| HUMTEN_PEA_1_T14 (SEQ ID NO:862) | 2752 | 3021 |
| HUMTEN_PEA_1_T16 (SEQ ID NO:863) | 2752 | 3021 |
| HUMTEN_PEA_1_T17 (SEQ ID NO:864) | 2752 | 3021 |
| HUMTEN_PEA_1_T18 (SEQ ID NO:865) | 2752 | 3021 |
| HUMTEN_PEA_1_T19 (SEQ ID NO:866) | 2752 | 3021 |
| HUMTEN_PEA_1_T20 (SEQ ID NO:867) | 2752 | 3021 |
| HUMTEN_PEA_1_T23 (SEQ ID NO:868) | 2752 | 3021 |
| HUMTEN_PEA_1_T32 (SEQ ID NO:869) | 2752 | 3021 |
| HUMTEN_PEA_1_T35 (SEQ ID NO:870) | 2752 | 3021 |
| HUMTEN_PEA_1_T36 (SEQ ID NO:871) | 2752 | 3021 |
| HUMTEN_PEA_1_T37 (SEQ ID NO:872) | 2752 | 3021 |
| HUMTEN_PEA_1_T39 (SEQ ID NO:873) | 2752 | 3021 |

Segment cluster HUMTEN_PEA_1_node_23 (SEQ ID NO: 884) according to the present invention is supported by 1 libraries. The number of libraries was determined as previously described. This segment can be found in the following transcript(s): HUMTEN_PEA_1_T39 (SEQ ID NO: 873). Table 72 below describes the starting and ending position of this segment on each transcript.

TABLE 72

Segment location on transcripts

| Transcript name | Segment starting position | Segment ending position |
|---|---|---|
| HUMTEN_PEA_1_T39 (SEQ ID NO:873) | 3208 | 3335 |

Segment cluster HUMTEN_PEA_1_node_27 (SEQ ID NO: 885) according to the present invention is supported by 43 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858) HUMTEN_PEA_1_T5 (SEQ 11D NO: 858) (SEQ ID NO: 859), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867), HUMTEN_PEA_1_T23 (SEQ ID NO: 868), HUMTEN_PEA_1_T32 (SEQ ID NO: 869), HUMTEN_PEA_1_T35 (SEQ ID NO: 870), HUMTEN_PEA_1_T36 (SEQ ID NO: 871) and HUMTEN_PEA_1_T37 (SEQ ID NO: 872). Table 73 below describes the starting and ending position of this segment on each transcript.

TABLE 73

Segment location on transcripts

| Transcript name | Segment starting position | Segment ending position |
|---|---|---|
| HUMTEN_PEA_1_T4 (SEQ ID NO:857) | 3298 | 3561 |
| HUMTEN_PEA_1_T5 (SEQ ID NO:858) | 3298 | 3561 |
| HUMTEN_PEA_1_T5 (SEQ ID NO:858) (SEQ ID NO:859) | | |
| HUMTEN_PEA_1_T6 (SEQ ID NO:859) | 3298 | 3561 |
| HUMTEN_PEA_1_T7 (SEQ ID NO:860) | 3298 | 3561 |
| HUMTEN_PEA_1_T11 (SEQ ID NO:861) | 3298 | 3561 |
| HUMTEN_PEA_1_T14 (SEQ ID NO:862) | 3298 | 3561 |
| HUMTEN_PEA_1_T16 (SEQ ID NO:863) | 3298 | 3561 |
| HUMTEN_PEA_1_T17 (SEQ ID NO:864) | 3298 | 3561 |
| HUMTEN_PEA_1_T18 (SEQ ID NO:865) | 3298 | 3561 |
| HUMTEN_PEA_1_T19 (SEQ ID NO:866) | 3298 | 3561 |
| HUMTEN_PEA_1_T20 (SEQ ID NO:867) | 3298 | 3561 |
| HUMTEN_PEA_1_T23 (SEQ ID NO:868) | 3298 | 3561 |
| HUMTEN_PEA_1_T32 (SEQ ID NO:869) | 3298 | 3561 |
| HUMTEN_PEA_1_T35 (SEQ ID NO:870) | 3298 | 3561 |
| HUMTEN_PEA_1_T36 (SEQ ID NO:871) | 3298 | 3561 |
| HUMTEN_PEA_1_T37 (SEQ ID NO:872) | 3298 | 3561 |

Segment cluster HUMTEN_PEA_1_node_28 (SEQ ID NO: 886) according to the present invention is supported by 2 libraries. The number of libraries was determined as previously described. This segment can be found in the following transcript(s): HUMTEN_PEA_1_T37 (SEQ ID NO: 872).

Table 74 below describes the starting and ending position of this segment on each transcript.

TABLE 74

Segment location on transcripts

| Transcript name | Segment starting position | Segment ending position |
|---|---|---|
| HUMTEN_PEA_1_T37 (SEQ ID NO:872) | 3562 | 3762 |

Segment cluster HUMTEN_PEA_1_node_30 (SEQ ID NO: 887) according to the present invention is supported by 19 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T20 (SEQ ID NO. 867), HUMTEN_PEA_1_T23 (SEQ ID NO: 868), HUMTEN_PEA_1_T32 (SEQ ID NO: 869), HUMTEN_PEA_1_T35 (SEQ ID NO: 870) and HUMTEN_PEA_1_T36 (SEQ ID NO: 871). Table 75 below describes the starting and ending position of this segment on each transcript.

TABLE 75

Segment location on transcripts

| Transcript name | Segment starting position | Segment ending position |
|---|---|---|
| HUMTEN_PEA_1_T4 (SEQ ID NO:857) | 3562 | 3834 |
| HUMTEN_PEA_1_T5 (SEQ ID NO:858) | 3562 | 3834 |
| HUMTEN_PEA_1_T6 (SEQ ID NO:859) | 3562 | 3834 |
| HUMTEN_PEA_1_T7 (SEQ ID NO:860) | 3562 | 3834 |
| HUMTEN_PEA_1_T11 (SEQ ID NO:861) | 3562 | 3834 |
| HUMTEN_PEA_1_T14 (SEQ ID NO:862) | 3562 | 3834 |
| HUMTEN_PEA_1_T16 (SEQ ID NO:863) | 3562 | 3834 |
| HUMTEN_PEA_1_T17 (SEQ ID NO:864) | 3562 | 3834 |
| HUMTEN_PEA_1_T20 (SEQ ID NO:867) | 3562 | 3834 |
| HUMTEN_PEA_1_T23 (SEQ ID NO:868) | 3562 | 3834 |
| HUMTEN_PEA_1_T32 (SEQ ID NO:869) | 3562 | 3834 |
| HUMTEN_PEA_1_T35 (SEQ ID NO:870) | 3562 | 3834 |
| HUMTEN_PEA_1_T36 (SEQ ID NO:871) | 3562 | 3834 |

Segment cluster HUMTEN_PEA_1_node_32 (SEQ ID NO: 888) according to the present invention is supported by 22 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T16 (SEQ ID NO: 863), HUMTEN_PEA_1_T17 (SEQ ID NO: 864), HUMTEN_PEA_1_T20 (SEQ ID NO. 867), HUMTEN_PEA_1_T23 (SEQ ID NO: 868), HUMTEN_PEA_1_T32 (SEQ ID NO: 869), HUMTEN_PEA_1_T35 (SEQ ID NO: 870) and HUMTEN_PEA_1_T36 (SEQ ID NO: 871). Table 76 below describes the starting and ending position of this segment on each transcript.

TABLE 76

Segment location on transcripts

| Transcript name | Segment starting position | Segment ending position |
|---|---|---|
| HUMTEN_PEA_1_T4 (SEQ ID NO:857) | 3835 | 4107 |
| HUMTEN_PEA_1_T5 (SEQ ID NO:858) | 3835 | 4107 |
| HUMTEN_PEA_1_T6 (SEQ ID NO:859) | 3835 | 4107 |
| HUMTEN_PEA_1_T7 (SEQ ID NO:860) | 3835 | 4107 |
| HUMTEN_PEA_1_T11 (SEQ ID NO:861) | 3835 | 4107 |
| HUMTEN_PEA_1_T16 (SEQ ID NO:863) | 3835 | 4107 |
| HUMTEN_PEA_1_T17 (SEQ ID NO:864) | 3835 | 4107 |
| HUMTEN_PEA_1_T20 (SEQ ID NO:867) | 3835 | 4107 |
| HUMTEN_PEA_1_T23 (SEQ ID NO:868) | 3835 | 4107 |
| HUMTEN_PEA_1_T32 (SEQ ID NO:869) | 3835 | 4107 |
| HUMTEN_PEA_1_T35 (SEQ ID NO:870) | 3835 | 4107 |
| HUMTEN_PEA_1_T36 (SEQ ID NO:871) | 3835 | 4107 |

Segment cluster HUMTEN_PEA_1_node_33 (SEQ ID NO: 889) according to the present invention is supported by 2 libraries. The number of libraries was determined as previously described. This segment can be found in the following transcript(s): HUMTEN_PEA_1_T36 (SEQ ID NO: 871). Table 77 below describes the starting and ending position of this segment on each transcript.

TABLE 77

Segment location on transcripts

| Transcript name | Segment starting position | Segment ending position |
|---|---|---|
| HUMTEN_PEA_1_T36 (SEQ ID NO:871) | 4108 | 4463 |

Segment cluster HUMTEN_PEA_1_node_35 (SEQ ID NO: 890) according to the present invention is supported by 21 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T16 (SEQ ID NO: 863), HUMTEN_PEA_1_T17 (SEQ ID NO: 864), HUMTEN_PEA_1_T20 (SEQ ID NO. 867), HUMTEN_PEA_1_T23 (SEQ ID NO: 868), HUMTEN_PEA_1_T32 (SEQ ID NO: 869) and HUMTEN_PEA_1_T35 (SEQ ID NO: 870). Table 78 below describes the starting and ending position of this segment on each transcript.

TABLE 78

Segment location on transcripts

| Transcript name | Segment starting position | Segment ending position |
|---|---|---|
| HUMTEN_PEA_1_T4 (SEQ ID NO:857) | 4108 | 4380 |
| HUMTEN_PEA_1_T5 (SEQ ID NO:858) | 4108 | 4380 |
| HUMTEN_PEA_1_T6 (SEQ ID NO:859) | 4108 | 4380 |
| HUMTEN_PEA_1_T7 (SEQ ID NO:860) | 4108 | 4380 |
| HUMTEN_PEA_1_T16 (SEQ ID NO:863) | 4108 | 4380 |
| HUMTEN_PEA_1_T17 (SEQ ID NO:864) | 4108 | 4380 |
| HUMTEN_PEA_1_T20 (SEQ ID NO:867) | 4108 | 4380 |
| HUMTEN_PEA_1_T23 (SEQ ID NO:868) | 4108 | 4380 |
| HUMTEN_PEA_1_T32 (SEQ ID NO:869) | 4108 | 4380 |
| HUMTEN_PEA_1_T35 (SEQ ID NO:870) | 4108 | 4380 |

Segment cluster HUMTEN_PEA_1_node_38 (SEQ ID NO: 891) according to the present invention is supported by 22 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T17 (SEQ ID NO: 864), HUMTEN_PEA_1_T20 (SEQ ID NO. 867), HUMTEN_PEA_1_T23 (SEQ ID NO: 868) and HUMTEN_PEA_1_T32 (SEQ ID NO: 869). Table 79 below describes the starting and ending position of this segment on each transcript.

TABLE 79

Segment location on transcripts

| Transcript name | Segment starting position | Segment ending position |
|---|---|---|
| HUMTEN_PEA_1_T4 (SEQ ID NO:857) | 4381 | 4653 |
| HUMTEN_PEA_1_T5 (SEQ ID NO:858) | 4381 | 4653 |
| HUMTEN_PEA_1_T6 (SEQ ID NO:859) | 4381 | 4653 |
| HUMTEN_PEA_1_T7 (SEQ ID NO:860) | 4381 | 4653 |
| HUMTEN_PEA_1_T11 (SEQ ID NO:861) | 4108 | 4380 |
| HUMTEN_PEA_1_T17 (SEQ ID NO:864) | 4381 | 4653 |
| HUMTEN_PEA_1_T20 (SEQ ID NO:867) | 4381 | 4653 |
| HUMTEN_PEA_1_T23 (SEQ ID NO:868) | 4381 | 4653 |
| HUMTEN_PEA_1_T32 (SEQ ID NO:869) | 4381 | 4653 |

Segment cluster HUMTEN_PEA_1_node_40 (SEQ ID NO: 892) according to the present invention is supported by 22 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T17 (SEQ ID NO: 864), HUMTEN_PEA_1_T20 (SEQ ID NO. 867), HUMTEN_PEA_1_T23 (SEQ ID NO: 868) and HUMTEN_PEA_1_T32 (SEQ ID NO: 869). Table 80 below describes the starting and ending position of this segment on each transcript.

TABLE 80

Segment location on transcripts

| Transcript name | Segment starting position | Segment ending position |
|---|---|---|
| HUMTEN_PEA_1_T4 (SEQ ID NO:857) | 4654 | 4926 |
| HUMTEN_PEA_1_T5 (SEQ ID NO:858) | 4654 | 4926 |
| HUMTEN_PEA_1_T6 (SEQ ID NO:859) | 4654 | 4926 |
| HUMTEN_PEA_1_T7 (SEQ ID NO:860) | 4654 | 4926 |
| HUMTEN_PEA_1_T11 (SEQ ID NO:861) | 4381 | 4653 |

TABLE 80-continued

Segment location on transcripts

| Transcript name | Segment starting position | Segment ending position |
|---|---|---|
| HUMTEN_PEA_1_T14 (SEQ ID NO:862) | 3835 | 4107 |
| HUMTEN_PEA_1_T17 (SEQ ID NO:864) | 4654 | 4926 |
| HUMTEN_PEA_1_T20 (SEQ ID NO:867) | 4654 | 4926 |
| HUMTEN_PEA_1_T23 (SEQ ID NO:868) | 4654 | 4926 |
| HUMTEN_PEA_1_T32 (SEQ ID NO:869) | 4654 | 4926 |

Segment cluster HUMTEN_PEA_1_node_42 (SEQ ID NO: 893) according to the present invention is supported by 4 libraries. The number of libraries was determined as previously described. This segment can be found in the following transcript(s): HUMTEN_PEA_1_T4 (SEQ ID NO: 857) and HUMTEN_PEA_1_T5 (SEQ ID NO: 858). Table 81 below describes the starting and ending position of this segment on each transcript.

TABLE 81

Segment location on transcripts

| Transcript name | Segment starting position | Segment ending position |
|---|---|---|
| HUMTEN_PEA_1_T4 (SEQ ID NO:857) | 4927 | 5202 |
| HUMTEN_PEA_1_T5 (SEQ ID NO:858) | 4927 | 5202 |

Segment cluster HUMTEN_PEA_1_node_43 (SEQ ID NO: 894) according to the present invention is supported by 27 libraries. The number of libraries was determined as previously described. This segment can be found in the following transcript(s): HUMTEN_1_PEA_1_T5 (SEQ ID NO: 858). Table 82 below describes the starting and ending position of this segment on each transcript.

TABLE 82

Segment location on transcripts

| Transcript name | Segment starting position | Segment ending position |
|---|---|---|
| HUMTEN_PEA_1_T5 (SEQ ID NO: 858) | 5203 | 9409 |

Segment cluster HUMTEN_PEA_1_node_44 (SEQ ID NO: 895) according to the present invention is supported by 15 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T11 (SEQ ID NO: 861), HUMTEN_PEA_1_T14 (SEQ ID NO: 862), HUMTEN_PEA_1_T17 (SEQ ID NO: 864), HUMTEN_PEA_1_T20 (SEQ ID NO. 867), HUMTEN_PEA_1_T23 (SEQ ID NO: 868) and HUMTEN_PEA_1_T32 (SEQ ID NO: 869). Table 83 below describes the starting and ending position of this segment on each transcript.

TABLE 83

Segment location on transcripts

| Transcript name | Segment starting postion | Segment ending position |
|---|---|---|
| HUMTEN_PEA_1_T4 (SEQ ID NO: 857) | 5203 | 5475 |
| HUMTEN_PEA_1_T5 (SEQ ID NO: 858) | 9410 | 9682 |
| HUMTEN_PEA_1_T6 (SEQ ID NO: 859) | 4927 | 5199 |
| HUMTEN_PEA_1_T11 (SEQ ID NO: 861) | 4654 | 4926 |
| HUMTEN_PEA_1_T14 (SEQ ID NO: 862) | 4108 | 4380 |
| HUMTEN_PEA_1_T17 (SEQ ID NO: 864) | 4927 | 5199 |
| HUMTEN_PEA_1_T20 (SEQ ID NO: 867) | 4927 | 5199 |
| HUMTEN_PEA_1_T23 (SEQ ID NO: 868) | 4927 | 5199 |
| HUMTEN_PEA_1_T32 (SEQ ID NO: 869) | 4927 | 5199 |

Segment cluster HUMTEN_PEA_1_node_45 (SEQ ID NO: 896) according to the present invention is supported by 17 libraries. The number of libraries was determined as previously described. This segment can be found in the following transcript(s): HUMTEN_PEA_1_T6 (SEQ ID NO: 859). Table 84 below describes the starting and ending position of this segment on each transcript.

TABLE 84

Segment location on transcripts

| Transcript name | Segment starting position | Segment ending position |
|---|---|---|
| HUMTEN_PEA_1_T6 (SEQ ID NO: 859) | 5200 | 6776 |

Segment cluster HUMTEN_PEA_1_node_46 (SEQ ID NO: 897) according to the present invention is supported by 40 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T17 (SEQ ID NO: 864), HUMTEN_PEA_1_T18 (SEQ ID NO: 865), HUMTEN_PEA_1_T20 (SEQ ID NO. 867), HUMTEN_PEA_1_T23 (SEQ ID NO: 868) and HUMTEN_PEA_1_T32 (SEQ ID NO: 869). Table 85 below describes the starting and ending position of this segment on each transcript.

TABLE 85

Segment location on transcripts

| Transcript name | Segment starting position | Segment ending position |
|---|---|---|
| HUMTEN_PEA_1_T4 (SEQ ID NO: 857) | 5476 | 5748 |
| HUMTEN_PEA_1_T5 (SEQ ID NO: 858) | 9683 | 9955 |
| HUMTEN_PEA_1_T6 (SEQ ID NO: 859) | 6777 | 7049 |
| HUMTEN_PEA_1_T7 (SEQ ID NO: 860) | 4927 | 5199 |
| HUMTEN_PEA_1_T11 (SEQ ID NO: 861) | 4927 | 5199 |
| HUMTEN_PEA_1_T14 (SEQ ID NO: 862) | 4381 | 4653 |
| HUMTEN_PEA_1_T17 (SEQ ID NO: 864) | 5200 | 5472 |
| HUMTEN_PEA_1_T18 (SEQ ID NO: 865) | 3562 | 3834 |
| HUMTEN_PEA_1_T20 (SEQ ID NO: 867) | 5200 | 5472 |
| HUMTEN_PEA_1_T23 (SEQ ID NO: 868) | 5200 | 5472 |
| HUMTEN_PEA_1_T32 (SEQ ID NO: 869) | 5200 | 5472 |

Segment cluster HUMTEN_PEA_1_node_47 (SEQ ID NO: 898) according to the present invention is supported by 8 libraries. The number of libraries was determined as previously described. This segment can be found in the following transcript(s): HUMTEN_PEA_1_T32 (SEQ ID NO: 869). Table 86 below describes the starting and ending position of this segment on each transcript.

TABLE 86

Segment location on transcripts

| Transcript name | Segment starting position | Segment ending position |
|---|---|---|
| HUMTEN_PEA_1_T32 (SEQ ID NO: 869) | 5473 | 6320 |

Segment cluster HUMTEN_PEA_1_node_49 (SEQ ID NO: 899) according to the present invention is supported by 59 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T7 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867) and HUMTEN_PEA_1_T23 (SEQ ID NO: 868). Table 87 below describes the starting and ending position of this segment on each transcript.

TABLE 87

Segment location on transcripts

| Transcript name | Segment starting position | Segment ending position |
|---|---|---|
| HUMTEN_PEA_1_T4 (SEQ ID NO: 857) | 5749 | 5871 |
| HUMTEN_PEA_1_T5 (SEQ ID NO: 858) | 9956 | 10078 |
| HUMTEN_PEA_1_T6 (SEQ ID NO: 859) | 7050 | 7172 |
| HUMTEN_PEA_1_T7 (SEQ ID NO: 860) | 5200 | 5322 |
| HUMTEN_PEA_1_T11 (SEQ ID NO: 861) | 5200 | 5322 |
| HUMTEN_PEA_1_T14 (SEQ ID NO: 862) | 4654 | 4776 |
| HUMTEN_PEA_1_T16 (SEQ ID NO: 863) | 4381 | 4503 |
| HUMTEN_PEA_1_T17 (SEQ ID NO: 864) | 5473 | 5595 |
| HUMTEN_PEA_1_T18 (SEQ ID NO: 865) | 3835 | 3957 |
| HUMTEN_PEA_1_T19 (SEQ ID NO: 866) | 3562 | 3684 |
| HUMTEN_PEA_1_T20 (SEQ ID NO: 867) | 5473 | 5595 |
| HUMIEN_PEA_1_T23 (SEQ ID NO: 868) | 5473 | 5595 |

Segment cluster HUMTEN_PEA_1_node_51 (SEQ ID NO: 900) according to the present invention is supported by 74 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T7 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867) and HUMTEN_PEA_1_T23 (SEQ ID NO: 868). Table 88 below describes the starting and ending position of this segment on each transcript.

TABLE 88

Segment location on transcripts

| Transcript name | Segment starting position | Segment ending position |
|---|---|---|
| HUMTEN_PEA_1_T4 (SEQ ID NO: 857) | 5872 | 6015 |
| HUMTEN_PEA_1_T5 (SEQ ID NO: 858) | 10079 | 10222 |
| HUMTEN_PEA_1_T6 (SEQ ID NO: 859) | 7173 | 7316 |
| HUMTEN_PEA_1_T7 (SEQ ID NO: 860) | 5323 | 5466 |
| HUMTEN_PEA_1_T11 (SEQ ID NO: 861) | 5323 | 5466 |
| HUMTEN_PEA_1_T14 (SEQ ID NO: 862) | 4777 | 4920 |
| HUMTEN_PEA_1_T16 (SEQ ID NO: 863) | 4504 | 4647 |
| HUMTEN_PEA_1_T17 (SEQ ID NO: 864) | 5596 | 5739 |
| HUMTEN_PEA_1_T18 (SEQ ID NO: 865) | 3958 | 4101 |

TABLE 88-continued

Segment location on transcripts

| Transcript name | Segment starting position | Segment ending position |
|---|---|---|
| HUMTEN_PEA_1_T19 (SEQ ID NO: 866) | 3685 | 3828 |
| HUMTEN_PEA_1_T20 (SEQ ID NO: 867) | 5596 | 5739 |
| HUMTEN_PEA_1_T23 (SEQ ID NO: 868) | 5596 | 5739 |

Segment cluster HUMTEN_PEA_1_node_56 (SEQ ID NO: 901) according to the present invention is supported by 84 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867) and HUMTEN_PEA_1_T23 (SEQ ID NO: 868). Table 89 below describes the starting and ending position of this segment on each transcript.

TABLE 89

Segment location on transcripts

| Transcript name | Segment starting position | Segment ending position |
|---|---|---|
| HUMTEN_PEA_1_T4 (SEQ ID NO: 857) | 6136 | 6261 |
| HUMTEN_PEA_1_T5 (SEQ ID NO: 858) | 10343 | 10468 |
| HUMTEN_PEA_1_T6 (SEQ ID NO: 859) | 7437 | 7562 |
| HUMTEN_PEA_1_T7 (SEQ ID NO: 860) | 5587 | 5712 |
| HUMTEN_PEA_1_T11 (SEQ ID NO: 861) | 5587 | 5712 |
| HUMTEN_PEA_1_T14 (SEQ ID NO: 862) | 5041 | 5166 |
| HUMTEN_PEA_1_T16 (SEQ ID NO: 863) | 4768 | 4893 |
| HUMTEN_PEA_1_T17 (SEQ ID NO: 864) | 5860 | 5985 |
| HUMTEN_PEA_1_T18 (SEQ ID NO: 865) | 4222 | 4347 |
| HUMTEN_PEA_1_T19 (SEQ ID NO: 866) | 3949 | 4074 |
| HUMTEN_PEA_1_T20 (SEQ ID NO: 867) | 5860 | 5985 |
| HUMTEN_PEA_1_T23 (SEQ ID NO: 868) | 5860 | 5985 |

Segment cluster HUMTEN_PEA_1_node_65 (SEQ ID NO: 902) according to the present invention is supported by 103 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T6 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867) and HUMTEN_PEA_1_T23 (SEQ ID NO: 868). Table 90 below describes the starting and ending position of this segment on each transcript.

TABLE 90

Segment location on transcripts

| Transcript name | Segment starting position | Segment ending position |
|---|---|---|
| HUMTEN_PEA_1_T4 (SEQ ID NO: 857) | 6411 | 6543 |
| HUMTEN_PEA_1_T5 (SEQ ID NO: 858) | 10618 | 10750 |
| HUMTEN_PEA_1_T6 (SEQ ID NO: 859) | 7712 | 7844 |
| HUMTEN_PEA_1_T7 (SEQ ID NO: 860) | 5862 | 5994 |
| HUMTEN_PEA_1_T11 (SEQ ID NO: 861) | 5862 | 5994 |
| HUMTEN_PEA_1_T14 (SEQ ID NO: 862) | 5316 | 5448 |
| HUMTEN_PEA_1_T16 (SEQ ID NO: 863) | 5043 | 5175 |
| HUMTEN_PEA_1_T17 (SEQ ID NO: 864) | 6135 | 6267 |
| HUMTEN_PEA_1_T18 (SEQ ID NO: 865) | 4497 | 4629 |
| HUMTEN_PEA_1_T19 (SEQ ID NO: 866) | 4224 | 4356 |
| HUMTEN_PEA_1_T20 (SEQ ID NO: 867) | 6135 | 6267 |
| HUMTEN_PEA_1_T23 (SEQ ID NO: 868) | 6135 | 6267 |

Segment cluster HUMTEN_PEA_1_node_71 (SEQ ID NO: 903) according to the present invention is supported by 6 libraries. The number of libraries was determined as previously described. This segment can be found in the following transcript(s): HUMTEN_PEA_1_T17 (SEQ ID NO: 864). Table 91 below describes the starting and ending position of this segment on each transcript.

TABLE 91

Segment location on transcripts

| Transcript name | Segment starting position | Segment ending position |
|---|---|---|
| HUMTEN_PEA_1_T17 (SEQ ID NO: 864) | 6420 | 7216 |

Segment cluster HUMTEN_PEA_1_node_73 (SEQ ID NO: 904) according to the present invention is supported by 4 libraries. The number of libraries was determined as previously described. This segment can be found in the following transcript(s): HUMTEN_PEA_1_T23 (SEQ ID NO: 868). Table 92 below describes the starting and ending position of this segment on each transcript.

TABLE 92

Segment location on transcripts

| Transcript name | Segment starting position | Segment ending position |
|---|---|---|
| HUMTEN_PEA_1_T23 (SEQ ID NO: 868) | 6517 | 6843 |

Segment cluster HUMTEN_PEA_1_node_76 (SEQ ID NO: 905) according to the present invention is supported by 124 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865) and HUMTEN_PEA_1_T19 (SEQ ID NO: 866). Table 93 below describes the starting and ending position of this segment on each transcript.

TABLE 93

Segment location on transcripts

| Transcript name | Segment starting position | Segment ending position |
|---|---|---|
| HUMTEN_PEA_1_T4 (SEQ ID NO: 857) | 6793 | 6954 |
| HUMTEN_PEA_1_T5 (SEQ ID NO: 858) | 11000 | 11161 |
| HUMTEN_PEA_1_T6 (SEQ ID NO: 859) | 8094 | 8255 |
| HUMTEN_PEA_1_T7 (SEQ ID NO: 860) | 6244 | 6405 |
| HUMTEN_PEA_1_T11 (SEQ ID NO: 861) | 6244 | 6405 |
| HUMTEN_PEA_1_T14 (SEQ ID NO: 862) | 5698 | 5859 |
| HUMTEN_PEA_1_T16 (SEQ ID NO: 863) | 5425 | 5586 |
| HUMTEN_PEA_1_T17 (SEQ ID NO: 864) | 7314 | 7475 |
| HUMTEN_PEA_1_T18 (SEQ ID NO: 865) | 4879 | 5040 |
| HUMTEN_PEA_1_T19 (SEQ ID NO: 866) | 4606 | 4767 |

Segment cluster HUMTEN_PEA_1_node_79 (SEQ ID NO: 906) according to the present invention is supported by 139 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866) and HUMTEN_PEA_1_T20 (SEQ ID NO: 867). Table 94 below describes the starting and ending position of this segment on each transcript.

TABLE 94

Segment location on transcripts

| Transcript name | Segment starting position | Segment ending position |
|---|---|---|
| HUMTEN_PEA_1_T4 (SEQ ID NO: 857) | 6955 | 7118 |
| HUMTEN_PEA_1_T5 (SEQ ID NO: 858) | 11162 | 11325 |
| HUMTEN_PEA_1_T6 (SEQ ID NO: 859) | 8256 | 8419 |
| HUMTEN_PEA_1_T7 (SEQ ID NO: 860) | 6406 | 6569 |
| HUMTEN_PEA_1_T11 (SEQ ID NO: 861) | 6406 | 6569 |
| HUMTEN_PEA_1_T14 (SEQ ID NO: 862) | 5860 | 6023 |
| HUMTEN_PEA_1_T16 (SEQ ID NO: 863) | 5587 | 5750 |
| HUMTEN_PEA_1_T17 (SEQ ID NO: 864) | 7476 | 7639 |
| HUMTEN_PEA_1_T18 (SEQ ID NO: 865) | 5041 | 5204 |
| HUMTEN_PEA_1_T19 (SEQ ID NO: 866) | 4768 | 4931 |
| HUMTEN_PEA_1_T20 (SEQ ID NO: 867) | 6420 | 6583 |

Segment cluster HUMTEN_PEA_1_node_83 (SEQ ID NO: 907) according to the present invention is supported by 150 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866) and HUMTEN_PEA_1_T20 (SEQ ID NO: 867). Table 95 below describes the starting and ending position of this segment on each transcript.

TABLE 95

Segment location on transcripts

| Transcript name | Segment starting position | Segment ending position |
|---|---|---|
| HUMTEN_PEA_1_T4 (SEQ ID NO: 857) | 7119 | 7240 |
| HUMTEN_PEA_1_T5 (SEQ ID NO: 858) | 11326 | 11447 |
| HUMTEN_PEA_1_T6 (SEQ ID NO: 859) | 8420 | 8541 |
| HUMTEN_PEA_1_T7 (SEQ ID NO: 860) | 6570 | 6691 |
| HUMTEN_PEA_1_T11 (SEQ ID NO: 861) | 6570 | 6691 |
| HUMTEN_PEA_1_T14 (SEQ ID NO: 862) | 6024 | 6145 |
| HUMTEN_PEA_1_T16 (SEQ ID NO: 863) | 5751 | 5872 |
| HUMTEN_PEA_1_T17 (SEQ ID NO: 864) | 7640 | 7761 |
| HUMTEN_PEA_1_T18 (SEQ ID NO: 865) | 5205 | 5326 |
| HUMTEN_PEA_1_T19 (SEQ ID NO: 866) | 4932 | 5053 |
| HUMTEN_PEA_1_T20 (SEQ ID NO: 867) | 6584 | 6705 |

Segment cluster HUMTEN_PEA_1_node_89 (SEQ ID NO: 908) according to the present invention is supported by 196 libraries. The number of libraries was determined as previously described. This segment can be found in the following transcript(s): HUMTEN_PEA_1_T4 (SEQ ID NO:

857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866) and HUMTEN_PEA_1_T20 (SEQ ID NO. 867). Table 96 below describes the starting and ending position of this segment on each transcript.

TABLE 96

Segment location on transcripts

| Transcript name | Segment starting position | Segment ending position |
|---|---|---|
| HUMTEN_PEA_1_T4 (SEQ ID NO: 857) | 7559 | 8816 |
| HUMTEN_PEA_1_T5 (SEQ ID NO: 858) | 11766 | 13023 |
| HUMTEN_PEA_1_T6 (SEQ ID NO: 859) | 8860 | 10117 |
| HIJMTEN_PEA_1_T7 (SEQ ID NO: 860) | 7010 | 8267 |
| HUMTEN_PEA_1_T11 (SEQ ID NO: 861) | 7010 | 8267 |
| HUMTEN_PEA_1_T14 (SEQ ID NO: 862) | 6464 | 7721 |
| HUMTEN_PEA_1_T16 (SEQ ID NO: 863) | 6191 | 7448 |
| HUMTEN_PEA_1_T17 (SEQ ID NO: 864) | 8080 | 9337 |
| HUMTEN_PEA_1_T18 (SEQ ID NO: 865) | 5645 | 6902 |
| HUMTEN_PEA_1_T19 (SEQ ID NO: 866) | 5372 | 6629 |
| HUMTEN_PEA_1_T20 (SEQ ID NO: 867) | 7024 | 8281 |

According to an optional embodiment of the present invention, short segments related to the above cluster are also provided. These segments are up to about 120 bp in length, and so are included in a separate description.

Segment cluster HUMTEN_PEA_1_node_7 (SEQ ID NO: 909) according to the present invention is supported by 25 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867), HUMTEN_PEA_1_T23 (SEQ ID NO: 868), HUMTEN_PEA_1_T32 (SEQ ID NO: 869), HUMTEN_PEA_1_T35 (SEQ ID NO: 870), HUMTEN_PEA_1_T36 (SEQ ID NO: 871), HUMTEN_PEA_1_T37 (SEQ ID NO: 872), HUMTEN_PEA_1_T39 (SEQ ID NO: 873), HUMTEN_PEA_1_T40 (SEQ ID NO: 874) and HUMTEN_PEA_1_T41 (SEQ ID NO: 875). Table 97 below describes the starting and ending position of this segment on each transcript.

TABLE 97

Segment location on transcripts

| Transcript name | Segment starting position | Segment ending position |
|---|---|---|
| HUMTEN_PEA_1_T4 (SEQ ID NO:857) | 1926 | 2040 |
| HUMTEN_PEA_1_T5 (SEQ ID NO:858) | 1926 | 2040 |
| HUMTEN_PEA_1_T6 (SEQ ID NO:859) | 1926 | 2040 |
| HUMTEN_PEA_1_T7 (SEQ ID NO:860) | 1926 | 2040 |
| HUMTEN_PEA_1_T11 (SEQ ID NO:861) | 1926 | 2040 |
| HUMTEN_PEA_1_T14 (SEQ ID NO:862) | 1926 | 2040 |
| HUMTEN_PEA_1_T16 (SEQ ID NO:863) | 1926 | 2040 |
| HUMTEN_PEA_1_T17 (SEQ ID NO:864) | 1926 | 2040 |
| HUMTEN_PEA_1_T18 (SEQ ID NO:865) | 1926 | 2040 |
| HUMTEN_PEA_1_T19 (SEQ ID NO:866) | 1926 | 2040 |
| HUMTEN_PEA_1_T20 (SEQ ID NO:867) | 1926 | 2040 |
| HUMTEN_PEA_1_T23 (SEQ ID NO:868) | 1926 | 2040 |
| HUMTEN_PEA_1_T32 (SEQ ID NO:869) | 1926 | 2040 |
| HUMTEN_PEA_1_T35 (SEQ ID NO:870) | 1926 | 2040 |
| HUMTEN_PEA_1_T36 (SEQ ID NO:871) | 1926 | 2040 |
| HUMTEN_PEA_1_T37 (SEQ ID NO:872) | 1926 | 2040 |
| HUMTEN_PEA_1_T39 (SEQ ID NO:873) | 1926 | 2040 |
| HUMTEN_PEA_1_T40 (SEQ ID NO:874) | 1926 | 2040 |
| HUMTEN_PEA_1_T41 (SEQ ID NO:875) | 1926 | 2040 |

Segment cluster HUMTEN_PEA_1_node_8 according to the present invention is supported by 25 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867), HUMTEN_PEA_1_T23 (SEQ ID NO: 868), HUMTEN_PEA_1_T32

(SEQ ID NO: 869), HUMTEN_PEA_1_T35 (SEQ ID NO: 870), HUMTEN_PEA_1_T36 (SEQ ID NO: 871), HUMTEN_PEA_1_T37 (SEQ ID NO: 872), HUMTEN_PEA_1_T39 (SEQ ID NO: 873), HUMTEN_PEA_1_T40 (SEQ ID NO: 874) and HUMTEN_PEA_1_T41 (SEQ ID NO: 875). Table 98 below describes the starting and ending position of this segment on each transcript.

TABLE 98

Segment location on transcripts

| Transcript name | Segment starting position | Segment ending position |
|---|---|---|
| HUMTEN_PEA_1_T4 (SEQ ID NO:857) | 2041 | 2134 |
| HUMTEN_PEA_1_T5 (SEQ ID NO:858) | 2041 | 2134 |
| HUMTEN_PEA_1_T6 (SEQ ID NO:859) | 2041 | 2134 |
| HUMTEN_PEA_1_T7 (SEQ ID NO:860) | 2041 | 2134 |
| HUMTEN_PEA_1_T11 (SEQ ID NO:861) | 2041 | 2134 |
| HUMTEN_PEA_1_T14 (SEQ ID NO:862) | 2041 | 2134 |
| HUMTEN_PEA_1_T16 (SEQ ID NO:863) | 2041 | 2134 |
| HUMTEN_PEA_1_T17 (SEQ ID NO:864) | 2041 | 2134 |
| HUMTEN_PEA_1_T18 (SEQ ID NO:865) | 2041 | 2134 |
| HUMTEN_PEA_1_T19 (SEQ ID NO:866) | 2041 | 2134 |
| HUMTEN_PEA_1_T20 (SEQ ID NO:867) | 2041 | 2134 |
| HUMTEN_PEA_1_T23 (SEQ ID NO:868) | 2041 | 2134 |
| HUMTEN_PEA_1_T32 (SEQ ID NO:869) | 2041 | 2134 |
| HUMTEN_PEA_1_T35 (SEQ ID NO:870) | 2041 | 2134 |
| HUMTEN_PEA_1_T36 (SEQ ID NO:871) | 2041 | 2134 |
| HUMTEN_PEA_1_T37 (SEQ ID NO:872) | 2041 | 2134 |
| HUMTEN_PEA_1_T39 (SEQ ID NO:873) | 2041 | 2134 |
| HUMTEN_PEA_1_T40 (SEQ ID NO:874) | 2041 | 2134 |
| HUMTEN_PEA_1_T41 (SEQ ID NO:875) | 2041 | 2134 |

Segment cluster HUMTEN_PEA_1_node_9 (SEQ ID NO: 911) according to the present invention is supported by 25 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867), HUMTEN_PEA_1_T23 (SEQ ID NO: 868), HUMTEN_PEA_1_T32 (SEQ ID NO: 869), HUMTEN_PEA_1_T35 (SEQ ID NO: 870), HUMTEN_PEA_1_T36 (SEQ ID NO: 871), HUMTEN_PEA_1_T37 (SEQ ID NO: 872), HUMTEN_PEA_1_T39 (SEQ ID NO: 873), HUMTEN_PEA_1_T40 (SEQ ID NO: 874) and HUMTEN_PEA_1_T41 (SEQ ID NO: 875). Table 99 below describes the starting and ending position of this segment on each transcript.

TABLE 99

Segment location on transcripts

| Transcript name | Segment starting position | Segment ending position |
|---|---|---|
| HUMTEN_PEA_1_T4 (SEQ ID NO:857) | 2135 | 2214 |
| HUMTEN_PEA_1_T5 (SEQ ID NO:858) | 2135 | 2214 |
| HUMTEN_PEA_1_T6 (SEQ ID NO:859) | 2135 | 2214 |
| HUMTEN_PEA_1_T7 (SEQ ID NO:860) | 2135 | 2214 |
| HUMTEN_PEA_1_T11 (SEQ ID NO:861) | 2135 | 2214 |
| HUMTEN_PEA_1_T14 (SEQ ID NO:862) | 2135 | 2214 |
| HUMTEN_PEA_1_T16 (SEQ ID NO:863) | 2135 | 2214 |
| HUMTEN_PEA_1_T17 (SEQ ID NO:864) | 2135 | 2214 |
| HUMTEN_PEA_1_T18 (SEQ ID NO:865) | 2135 | 2214 |
| HUMTEN_PEA_1_T19 (SEQ ID NO:866) | 2135 | 2214 |
| HUMTEN_PEA_1_T20 (SEQ ID NO:867) | 2135 | 2214 |
| HUMTEN_PEA_1_T23 (SEQ ID NO:868) | 2135 | 2214 |
| HUMTEN_PEA_1_T32 (SEQ ID NO:869) | 2135 | 2214 |
| HUMTEN_PEA_1_T35 (SEQ ID NO:870) | 2135 | 2214 |
| HUMTEN_PEA_1_T36 (SEQ ID NO:871) | 2135 | 2214 |
| HUMTEN_PEA_1_T37 (SEQ ID NO:872) | 2135 | 2214 |
| HUMTEN_PEA_1_T39 (SEQ ID NO:873) | 2135 | 2214 |
| HUMTEN_PEA_1_T40 (SEQ ID NO:874) | 2135 | 2214 |

TABLE 99-continued

Segment location on transcripts

| Transcript name | Segment starting position | Segment ending position |
|---|---|---|
| HUMTEN_PEA_1_T41 (SEQ ID NO:875) | 2135 | 2214 |

Segment cluster HUMTEN_PEA_1_node_14 (SEQ ID NO: 912) according to the present invention is supported by 24 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867), HUMTEN_PEA_1_T23 (SEQ ID NO: 868), HUMTEN_PEA_1_T32 (SEQ ID NO: 869), HUMTEN_PEA_1_T35 (SEQ ID NO: 870), HUMTEN_PEA_1_T36 (SEQ ID NO: 871), HUMTEN_PEA_1_T37 (SEQ ID NO: 872), HUMTEN_PEA_1_T39 (SEQ ID NO: 873) and HUMTEN_ PEA_1_T40 (SEQ ID NO: 874). Table 100 below describes the starting and ending position of this segment on each transcript.

TABLE 100

Segment location on transcripts

| Transcript name | Segment starting position | Segment ending position |
|---|---|---|
| HUMTEN_PEA_1_T4 (SEQ ID NO:857) | 2479 | 2594 |
| HUMTEN_PEA_1_T5 (SEQ ID NO:858) | 2479 | 2594 |
| HUMTEN_PEA_1_T6 (SEQ ID NO:859) | 2479 | 2594 |
| HUMTEN_PEA_1_T7 (SEQ ID NO:860) | 2479 | 2594 |
| HUMTEN_PEA_1_T11 (SEQ ID NO:861) | 2479 | 2594 |
| HUMTEN_PEA_1_T14 (SEQ ID NO:862) | 2479 | 2594 |
| HUMTEN_PEA_1_T16 (SEQ ID NO:863) | 2479 | 2594 |
| HUMTEN_PEA_1_T17 (SEQ ID NO:864) | 2479 | 2594 |
| HUMTEN_PEA_1_T18 (SEQ ID NO:865) | 2479 | 2594 |
| HUMTEN_PEA_1_T19 (SEQ ID NO:866) | 2479 | 2594 |
| HUMTEN_PEA_1_T20 (SEQ ID NO:867) | 2479 | 2594 |

TABLE 100-continued

Segment location on transcripts

| Transcript name | Segment starting position | Segment ending position |
|---|---|---|
| HUMTEN_PEA_1_T23 (SEQ ID NO:868) | 2479 | 2594 |
| HUMTEN_PEA_1_T32 (SEQ ID NO:869) | 2479 | 2594 |
| HUMTEN_PEA_1_T35 (SEQ ID NO:870) | 2479 | 2594 |
| HUMTEN_PEA_1_T36 (SEQ ID NO:871) | 2479 | 2594 |
| HUMTEN_PEA_1_T37 (SEQ ID NO:872) | 2479 | 2594 |
| HUMTEN_PEA_1_T39 (SEQ ID NO:873) | 2479 | 2594 |
| HUMTEN_PEA_1_T40 (SEQ ID NO:874) | 2479 | 2594 |

Segment cluster HUMTEN_PEA_1_node_17 (SEQ ID NO: 913) according to the present invention is supported by 1 libraries. The number of libraries was determined as previously described. This segment can be found in the following transcript(s): HUMTEN_PEA_1_T40 (SEQ ID NO: 874). Table 101 below describes the starting and ending position of this segment on each transcript.

TABLE 101

Segment location on transcripts

| Transcript name | Segment starting position | Segment ending position |
|---|---|---|
| HUMTEN_PEA_1_T40 (SEQ ID NO:874) | 2752 | 2817 |

Segment cluster HUMTEN_PEA_1_node_21 (SEQ ID NO: 914) according to the present invention is supported by 24 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867), HUMTEN_PEA_1_T23 (SEQ ID NO: 868), HUMTEN_PEA_1_T32 (SEQ ID NO: 869), HUMTEN_PEA_1_T35 (SEQ ID NO: 870), HUMTEN_PEA_1_T36 (SEQ ID NO: 871), HUMTEN_PEA_1_T37 (SEQ ID NO: 872) and HUMTEN_PEA_1_T39 (SEQ ID NO: 873). Table 102 below describes the starting and ending position of this segment on each transcript.

787

TABLE 102

Segment location on transcripts

| Transcript name | Segment starting position | Segment ending position |
|---|---|---|
| HUMTEN_PEA_1_T4 (SEQ ID NO:857) | 3022 | 3111 |
| HUMTEN_PEA_1_T5 (SEQ ID NO:858) | 3022 | 3111 |
| HUMTEN_PEA_1_T6 (SEQ ID NO:859) | 3022 | 3111 |
| HUMTEN_PEA_1_T7 (SEQ ID NO:860) | 3022 | 3111 |
| HUMTEN_PEA_1_T11 (SEQ ID NO:861) | 3022 | 3111 |
| HUMTEN_PEA_1_T14 (SEQ ID NO:862) | 3022 | 3111 |
| HUMTEN_PEA_1_T16 (SEQ ID NO:863) | 3022 | 3111 |
| HUMTEN_PEA_1_T17 (SEQ ID NO:864) | 3022 | 3111 |
| HUMTEN_PEA_1_T18 (SEQ ID NO:865) | 3022 | 3111 |
| HUMTEN_PEA_1_T19 (SEQ ID NO:866) | 3022 | 3111 |
| HUMTEN_PEA_1_T20 (SEQ ID NO:867) | 3022 | 3111 |
| HUMTEN_PEA_1_T23 (SEQ ID NO:868) | 3022 | 3111 |
| HUMTEN_PEA_1_T32 (SEQ ID NO:869) | 3022 | 3111 |
| HUMTEN_PEA_1_T35 (SEQ ID NO:870) | 3022 | 3111 |
| HUMTEN_PEA_1_T36 (SEQ ID NO:871) | 3022 | 3111 |
| HUMTEN_PEA_1_T37 (SEQ ID NO:872) | 3022 | 3111 |
| HUMTEN_PEA_1_T39 (SEQ ID NO:873) | 3022 | 3111 |

Segment cluster HUMTEN_PEA_1_node_22 (SEQ ID NO: 915) according to the present invention is supported by 27 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867), HUMTEN_PEA_1_T23 (SEQ ID NO: 868), HUMTEN_PEA_1_T32 (SEQ ID NO: 869), HUMTEN_PEA_1_T35 (SEQ ID NO: 870), HUMTEN_PEA_1_T36 (SEQ ID NO: 871), HUMTEN_PEA_1_T37 (SEQ ID NO: 872) and HUMTEN_PEA_1_T39 (SEQ ID NO: 873). Table 103 below describes the starting and ending position of this segment on each transcript.

TABLE 103

Segment location on transcripts

| Transcript name | Segment starting position | Segment ending position |
|---|---|---|
| HUMTEN_PEA_1_T4 (SEQ ID NO:857) | 3112 | 3207 |
| HUMTEN_PEA_1_T5 (SEQ ID NO:858) | 3112 | 3207 |
| HUMTEN_PEA_1_T6 (SEQ ID NO:859) | 3112 | 3207 |
| HUMTEN_PEA_1_T7 (SEQ ID NO:860) | 3112 | 3207 |
| HUMTEN_PEA_1_T11 (SEQ ID NO:861) | 3112 | 3207 |
| HUMTEN_PEA_1_T14 (SEQ ID NO:862) | 3112 | 3207 |
| HUMTEN_PEA_1_T16 (SEQ ID NO:863) | 3112 | 3207 |
| HUMTEN_PEA_1_T17 (SEQ ID NO:864) | 3112 | 3207 |
| HUMTEN_PEA_1_T18 (SEQ ID NO:865) | 3112 | 3207 |
| HUMTEN_PEA_1_T19 (SEQ ID NO:866) | 3112 | 3207 |
| HUMTEN_PEA_1_T20 (SEQ ID NO:867) | 3112 | 3207 |
| HUMTEN_PEA_1_T23 (SEQ ID NO:868) | 3112 | 3207 |
| HUMTEN_PEA_1_T32 (SEQ ID NO:869) | 3112 | 3207 |
| HUMTEN_PEA_1_T35 (SEQ ID NO:870) | 3112 | 3207 |
| HUMTEN_PEA_1_T36 (SEQ ID NO:871) | 3112 | 3207 |
| HUMTEN_PEA_1_T37 (SEQ ID NO:872) | 3112 | 3207 |
| HUMTEN_PEA_1_T39 (SEQ ID NO:873) | 3112 | 3207 |

Segment cluster HUMTEN_PEA_1_node_25 (SEQ ID NO: 916) according to the present invention is supported by 31 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867), HUMTEN_PEA_1_T23 (SEQ ID NO: 868), HUMTEN_PEA_1_T32 (SEQ ID NO: 869), HUMTEN_PEA_1_T35

(SEQ ID NO: 870), HUMTEN_PEA_1_T36 (SEQ ID NO: 871) and HUMTEN_PEA_1_T37 (SEQ ID NO: 872). Table 104 below describes the starting and ending position of this segment on each transcript.

TABLE 104

Segment location on transcripts

| Transcript name | Segment starting position | Segment ending position |
|---|---|---|
| HUMTEN_PEA_1_T4 (SEQ ID NO:857) | 3208 | 3297 |
| HUMTEN_PEA_1_T5 (SEQ ID NO:858) | 3208 | 3297 |
| HUMTEN_PEA_1_T6 (SEQ ID NO:859) | 3208 | 3297 |
| HUMTEN_PEA_1_T7 (SEQ ID NO:860) | 3208 | 3297 |
| HUMTEN_PEA_1_T11 (SEQ ID NO:861) | 3208 | 3297 |
| HUMTEN_PEA_1_T14 (SEQ ID NO:862) | 3208 | 3297 |
| HUMTEN_PEA_1_T16 (SEQ ID NO:863) | 3208 | 3297 |
| HUMTEN_PEA_1_T17 (SEQ ID NO:864) | 3208 | 3297 |
| HUMTEN_PEA_1_T18 (SEQ ID NO:865) | 3208 | 3297 |
| HUMTEN_PEA_1_T19 (SEQ ID NO:866) | 3208 | 3297 |
| HUMTEN_PEA_1_T20 (SEQ ID NO:867) | 3208 | 3297 |
| HUMTEN_PEA_1_T23 (SEQ ID NO:868) | 3208 | 3297 |
| HUMTEN_PEA_1_T32 (SEQ ID NO:869) | 3208 | 3297 |
| HUMTEN_PEA_1_T35 (SEQ ID NO:870) | 3208 | 3297 |
| HUMTEN_PEA_1_T36 (SEQ ID NO:871) | 3208 | 3297 |
| HUMTEN_PEA_1_T37 (SEQ ID NO:872) | 3208 | 3297 |

Segment cluster HUMTEN_PEA_1_node_36 (SEQ ID NO: 917) according to the present invention is supported by 2 libraries. The number of libraries was determined as previously described. This segment can be found in the following transcript(s): HUMTEN_PEA_1_T35 (SEQ ID NO: 870). Table 105 below describes the starting and ending position of this segment on each transcript.

TABLE 105

Segment location on transcripts

| Transcript name | Segment starting position | Segment ending position |
|---|---|---|
| HUMTEN_PEA_1_T35 (SEQ ID NO:870) | 4381 | 4446 |

Segment cluster HUMTEN_PEA_1_node_53 (SEQ ID NO: 918) according to the present invention is supported by 68 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867) and HUMTEN_PEA_1_T23 (SEQ ID NO: 868). Table 106 below describes the starting and ending position of this segment on each transcript.

TABLE 106

Segment location on transcripts

| Transcript name | Segment starting position | Segment ending position |
|---|---|---|
| HUMTEN_PEA_1_T4 (SEQ ID NO:857) | 6016 | 6050 |
| HUMTEN_PEA_1_T5 (SEQ ID NO:858) | 10223 | 10257 |
| HUMTEN_PEA_1_T6 (SEQ ID NO:859) | 7317 | 7351 |
| HUMTEN_PEA_1_T7 (SEQ ID NO:860) | 5467 | 5501 |
| HUMTEN_PEA_1_T11 (SEQ ID NO:861) | 5467 | 5501 |
| HUMTEN_PEA_1_T14 (SEQ ID NO:862) | 4921 | 4955 |
| HUMTEN_PEA_1_T16 (SEQ ID NO:863) | 4648 | 4682 |
| HUMTEN_PEA_1_T17 (SEQ ID NO:864) | 5740 | 5774 |
| HUMTEN_PEA_1_T18 (SEQ ID NO:865) | 4102 | 4136 |
| HUMTEN_PEA_1_T19 (SEQ ID NO:866) | 3829 | 3863 |
| HUMTEN_PEA_1_T20 (SEQ ID NO:867) | 5740 | 5774 |
| HUMTEN_PEA_1_T23 (SEQ ID NO:868) | 5740 | 5774 |

Segment cluster HUMTEN_PEA_1_node_54 (SEQ ID NO: 919)) according to the present invention is supported by 72 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867) and HUMTEN_PEA_1_T23 (SEQ ID NO: 868). Table 107 below describes the starting and ending position of this segment on each transcript.

TABLE 107

Segment location on transcripts

| Transcript name | Segment starting position | Segment ending position |
|---|---|---|
| HUMTEN_PEA_1_T4 (SEQ ID NO:857) | 6051 | 6135 |
| HUMTEN_PEA_1_T5 (SEQ ID NO:858) | 10258 | 10342 |
| HUMTEN_PEA_1_T6 (SEQ ID NO:859) | 7352 | 7436 |
| HUMTEN_PEA_1_T7 (SEQ ID NO:860) | 5502 | 5586 |
| HUMTEN_PEA_1_T11 (SEQ ID NO:861) | 5502 | 5586 |
| HUMTEN_PEA_1_T14 (SEQ ID NO:862) | 4956 | 5040 |
| HUMTEN_PEA_1_T16 (SEQ ID NO:863) | 4683 | 4767 |
| HUMTEN_PEA_1_T17 (SEQ ID NO:864) | 5775 | 5859 |
| HUMTEN_PEA_1_T18 (SEQ ID NO:865) | 4137 | 4221 |
| HUMTEN_PEA_1_T19 (SEQ ID NO:866) | 3864 | 3948 |
| HUMTEN_PEA_1_T20 (SEQ ID NO:867) | 5775 | 5859 |
| HUMTEN_PEA_1_T23 (SEQ ID NO:868) | 5775 | 5859 |

Segment cluster HUMTEN_PEA_1_node_57 (SEQ ID NO: 920) according to the present invention can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867) and HUMTEN_PEA_1_T23 (SEQ ID NO: 868). Table 108 below describes the starting and ending position of this segment on each transcript.

TABLE 108

Segment location on transcripts

| Transcript name | Segment starting position | Segment ending position |
|---|---|---|
| HUMTEN_PEA_1_T4 (SEQ ID NO:857) | 6262 | 6279 |
| HUMTEN_PEA_1_T5 (SEQ ID NO:858) | 10469 | 10486 |

TABLE 108-continued

Segment location on transcripts

| Transcript name | Segment starting position | Segment ending position |
|---|---|---|
| HUMTEN_PEA_1_T6 (SEQ ID NO:859) | 7563 | 7580 |
| HUMTEN_PEA_1_T7 (SEQ ID NO:860) | 5713 | 5730 |
| HUMTEN_PEA_1_T11 (SEQ ID NO:861) | 5713 | 5730 |
| HUMTEN_PEA_1_T14 (SEQ ID NO:862) | 5167 | 5184 |
| HUMTEN_PEA_1_T16 (SEQ ID NO:863) | 4894 | 4911 |
| HUMTEN_PEA_1_T17 (SEQ ID NO:864) | 5986 | 6003 |
| HUMTEN_PEA_1_T18 (SEQ ID NO:865) | 4348 | 4365 |
| HUMTEN_PEA_1_T19 (SEQ ID NO:866) | 4075 | 4092 |
| HUMTEN_PEA_1_T20 (SEQ ID NO:867) | 5986 | 6003 |
| HUMTEN_PEA_1_T23 (SEQ ID NO:868) | 5986 | 6003 |

Segment cluster HUMTEN_PEA_1_node_61 (SEQ ID NO: 921) according to the present invention is supported by 75 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T7 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867) and HUMTEN_PEA_1_T23 (SEQ ID NO: 868). Table 109 below describes the starting and ending position of this segment on each transcript.

TABLE 109

Segment location on transcripts

| Transcript name | Segment starting position | Segment ending position |
|---|---|---|
| HUMTEN_PEA_1_T4 (SEQ ID NO:857) | 6280 | 6363 |
| HUMTEN_PEA_1_T5 (SEQ ID NO:858) | 10487 | 10570 |
| HUMTEN_PEA_1_T6 (SEQ ID NO:859) | 7581 | 7664 |
| HUMTEN_PEA_1_T7 (SEQ ID NO:860) | 5731 | 5814 |
| HUMTEN_PEA_1_T11 (SEQ ID NO:861) | 5731 | 5814 |

TABLE 109-continued

Segment location on transcripts

| Transcript name | Segment starting position | Segment ending position |
|---|---|---|
| HUMTEN_PEA_1_T14 (SEQ ID NO:862) | 5185 | 5268 |
| HUMTEN_PEA_1_T16 (SEQ ID NO:863) | 4912 | 4995 |
| HUMTEN_PEA_1_T17 (SEQ ID NO:864) | 6004 | 6087 |
| HUMTEN_PEA_1_T18 (SEQ ID NO:865) | 4366 | 4449 |
| HUMTEN_PEA_1_T19 (SEQ ID NO:866) | 4093 | 4176 |
| HUMTEN_PEA_1_T20 (SEQ ID NO:867) | 6004 | 6087 |
| HUMTEN_PEA_1_T23 (SEQ ID NO:868) | 6004 | 6087 |

Segment cluster HUMTEN_PEA_1_node_62 (SEQ ID NO: 922) according to the present invention is supported by 75 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867) and HUMTEN_PEA_1_T23 (SEQ ID NO: 868). Table 110 below describes the starting and ending position of this segment on each transcript.

TABLE 110

Segment location on transcripts

| Transcript name | Segment starting position | Segment ending position |
|---|---|---|
| HUMTEN_PEA_1_T4 (SEQ ID NO: 857) | 6364 | 6410 |
| HUMTEN_PEA_1_T5 (SEQ ID NO: 858) | 10571 | 10617 |
| HUMTEN_PEA_1_T6 (SEQ ID NO: 859) | 7665 | 7711 |
| HUMTEN_PEA_1_T7 (SEQ ID NO: 860) | 5815 | 5861 |
| HUMTEN_PEA_1_T11 (SEQ ID NO: 861) | 5815 | 5861 |
| HUMTEN_PEA_1_T14 (SEQ ID NO: 862) | 5269 | 5315 |
| HUMTEN_PEA_1_T16 (SEQ ID NO: 863) | 4996 | 5042 |
| HUMTEN_PEA_1_T17 (SEQ ID NO: 864) | 6088 | 6134 |
| HUMTEN_PEA_1_T18 (SEQ ID NO: 865) | 4450 | 4496 |
| HUMTEN_PEA_1_T19 (SEQ ID NO: 866) | 4177 | 4223 |
| HUMTEN_PEA_1_T20 (SEQ ID NO. 867) | 6088 | 6134 |
| HUMTEN_PEA_1_T23 (SEQ ID NO: 868) | 6088 | 6134 |

Segment cluster HUMTEN_PEA_1_node_67 (SEQ ID NO: 923) according to the present invention is supported by 92 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867) and HUMTEN_PEA_1_T23 (SEQ ID NO: 868). Table 111 below describes the starting and ending position of this segment on each transcript.

TABLE 111

Segment location on transcripts

| Transcript name | Segment starting position | Segment ending position |
|---|---|---|
| HUMTEN_PEA_1_T4 (SEQ ID NO: 857) | 6544 | 6587 |
| HUMTEN_PEA_1_T5 (SEQ ID NO: 858) | 10751 | 10794 |
| HUMTEN_PEA_1_T6 (SEQ ID NO: 859) | 7845 | 7888 |
| HUMTEN_PEA_1_T7 (SEQ ID NO: 860) | 5995 | 6038 |
| HUMTEN_PEA_1_T11 (SEQ ID NO: 861) | 5995 | 6038 |
| HUMTEN_PEA_1_T14 (SEQ ID NO: 862) | 5449 | 5492 |
| HUMTEN_PEA_1_T16 (SEQ ID NO: 863) | 5176 | 5219 |
| HUMTEN_PEA_1_T17 (SEQ ID NO: 864) | 6268 | 6311 |
| HUMTEN_PEA_1_T18 (SEQ ID NO: 865) | 4630 | 4673 |
| HUMTEN_PEA_1_T19 (SEQ ID NO: 866) | 4357 | 4400 |
| HUMTEN_PEA_1_T20 (SEQ ID NO. 867) | 6268 | 6311 |
| HUMTEN_PEA_1_T23 (SEQ ID NO: 868) | 6268 | 6311 |

Segment cluster HUMTEN_PEA_1_node_68 (SEQ ID NO: 924) according to the present invention is supported by 117 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T1 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO.

867) and HUMTEN_PEA_1_T23 (SEQ ID NO: 868). Table 112 below describes the starting and ending position of this segment on each transcript.

TABLE 112

Segment location on transcripts

| Transcript name | Segment starting position | Segment ending position |
|---|---|---|
| HUMTEN_PEA_1_T4 (SEQ ID NO: 857) | 6588 | 6668 |
| HUMTEN_PEA_1_T5 (SEQ ID NO: 858) | 10795 | 10875 |
| HUMTEN_PEA_1_T6 (SEQ ID NO: 859) | 7889 | 7969 |
| HUMTEN_PEA_1_T7 (SEQ ID NO: 860) | 6039 | 6119 |
| HUMTEN_PEA_1_T11 (SEQ ID NO: 861) | 6039 | 6119 |
| HUMTEN_PEA_1_T14 (SEQ ID NO: 862) | 5493 | 5573 |
| HUMTEN_PEA_1_T16 (SEQ ID NO: 863) | 5220 | 5300 |
| HUMTEN_PEA_1_T17 (SEQ ID NO: 864) | 6312 | 6392 |
| HUMTEN_PEA_1_T18 (SEQ ID NO: 865) | 4674 | 4754 |
| HUMTEN_PEA_1_T19 (SEQ ID NO: 866) | 4401 | 4481 |
| HUMTEN_PEA_1_T20 (SEQ ID NO. 867) | 6312 | 6392 |
| HUMTEN_PEA_1_T23 (SEQ ID NO: 868) | 6312 | 6392 |

Segment cluster HUMTEN_PEA_1_node_69 (SEQ ID NO: 925) according to the present invention can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867) and HUMTEN_PEA_1_T23 (SEQ ID NO: 868). Table 113 below describes the starting and ending position of this segment on each transcript.

TABLE 113

Segment location on transcripts

| Transcript name | Segment starting position | Segment ending position |
|---|---|---|
| HUMTEN_PEA_1_T4 (SEQ ID NO: 857) | 6669 | 6673 |
| HUMTEN_PEA_1_T5 (SEQ ID NO: 858) | 10876 | 10880 |
| HUMTEN_PEA_1_T6 (SEQ ID NO: 859) | 7970 | 7974 |
| HUMTEN_PEA_1_T7 (SEQ ID NO: 860) | 6120 | 6124 |
| HUMTEN_PEA_1_T11 (SEQ ID NO: 861) | 6120 | 6124 |
| HUMTEN_PEA_1_T14 (SEQ ID NO: 862) | 5574 | 5578 |
| HUMTEN_PEA_1_T16 (SEQ ID NO: 863) | 5301 | 5305 |
| HUMTEN_PEA_1_T17 (SEQ ID NO: 864) | 6393 | 6397 |
| HUMTEN_PEA_1_T18 (SEQ ID NO: 865) | 4755 | 4759 |

TABLE 113-continued

Segment location on transcripts

| Transcript name | Segment starting position | Segment ending position |
|---|---|---|
| HUMTEN_PEA_1_T19 (SEQ ID NO: 866) | 4482 | 4486 |
| HUMTEN_PEA_1_T20 (SEQ ID NO. 867) | 6393 | 6397 |
| HUMTEN_PEA_1_T23 (SEQ ID NO: 868) | 6393 | 6397 |

Segment cluster HUMTEN_PEA_1_node_70 (SEQ ID NO: 926) according to the present invention can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866), HUMTEN_PEA_1_T20 (SEQ ID NO. 867) and HUMTEN_PEA_1_T23 (SEQ ID NO: 868). Table 114 below describes the starting and ending position of this segment on each transcript.

TABLE 114

Segment location on transcripts

| Transcript name | Segment starting position | Segment ending position |
|---|---|---|
| HUMTEN_PEA_1_T4 (SEQ ID NO: 857) | 6674 | 6695 |
| HUMTEN_PEA_1_T5 (SEQ ID NO: 858) | 10881 | 10902 |
| HUMTEN_PEA_1_T6 (SEQ ID NO: 859) | 7975 | 7996 |
| HUMTEN_PEA_1_T7 (SEQ ID NO: 860) | 6125 | 6146 |
| HUMTEN_PEA_1_T11 (SEQ ID NO: 861) | 6125 | 6146 |
| HUMTEN_PEA_1_T14 (SEQ ID NO: 862) | 5579 | 5600 |
| HUMTEN_PEA_1_T16 (SEQ ID NO: 863) | 5306 | 5327 |
| HUMTEN_PEA_1_T17 (SEQ ID NO: 864) | 6398 | 6419 |
| HUMTEN_PEA_1_T18 (SEQ ID NO: 865) | 4760 | 4781 |
| HUMTEN_PEA_1_T19 (SEQ ID NO: 866) | 4487 | 4508 |
| HUMTEN_PEA_1_T20 (SEQ ID NO. 867) | 6398 | 6419 |
| HUMTEN_PEA_1_T23 (SEQ ID NO: 868) | 6398 | 6419 |

Segment cluster HUMTEN_PEA_1_node_72 (SEQ ID NO: 927) according to the present invention is supported by 121 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T7 (SEQ ID NO: 864), HUMTEN_PEA_1_T18 (SEQ ID NO: 865), HUMTEN_PEA_1_T19

(SEQ ID NO: 866) and HUMTEN_PEA_1_T23 (SEQ ID NO: 868). Table 115 below describes the starting and ending position of this segment on each transcript.

TABLE 115

Segment location on transcripts

| Transcript name | Segment starting position | Segment ending position |
|---|---|---|
| HUMTEN_PEA_1_T4 (SEQ ID NO: 857) | 6696 | 6792 |
| HUMTEN_PEA_1_T5 (SEQ ID NO: 858) | 10903 | 10999 |
| HUMTEN_PEA_1_T6 (SEQ ID NO: 859) | 7997 | 8093 |
| HUMTEN_PEA_1_T7 (SEQ ID NO: 860) | 6147 | 6243 |
| HUMTEN_PEA_1_T11 (SEQ ID NO: 861) | 6147 | 6243 |
| HUMTEN_PEA_1_T14 (SEQ ID NO: 862) | 5601 | 5697 |
| HUMTEN_PEA_1_T16 (SEQ ID NO: 863) | 5328 | 5424 |
| HUMTEN_PEA_1_T17 (SEQ ID NO: 864) | 7217 | 7313 |
| HUMTEN_PEA_1_T18 (SEQ ID NO: 865) | 4782 | 4878 |
| HUMTEN_PEA_1_T19 (SEQ ID NO: 866) | 4509 | 4605 |
| HUMTEN_PEA_1_T23 (SEQ ID NO: 868) | 6420 | 6516 |

Segment cluster HUMTEN_PEA_1_node_84 (SEQ ID NO: 928) according to the present invention is supported by 153 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866) and HUMTEN_PEA_1_T20 (SEQ ID NO. 867). Table 116 below describes the starting and ending position of this segment on each transcript.

TABLE 116

Segment location on transcripts

| Transcript name | Segment starting position | Segment ending position |
|---|---|---|
| HUMTEN_PEA_1_T4 (SEQ ID NO: 857) | 7241 | 7292 |
| HUMTEN_PEA_1_T5 (SEQ ID NO: 858) | 11448 | 11499 |
| HUMTEN_PEA_1_T6 (SEQ ID NO: 859) | 8542 | 8593 |
| HUMTEN_PEA_1_T7 (SEQ ID NO: 860) | 6692 | 6743 |
| HUMTEN_PEA_1_T11 (SEQ ID NO: 861) | 6692 | 6743 |
| HUMTEN_PEA_1_T14 (SEQ ID NO: 862) | 6146 | 6197 |
| HUMTEN_PEA_1_T16 (SEQ ID NO: 863) | 5873 | 5924 |
| HUMTEN_PEA_1_T17 (SEQ ID NO: 864) | 7762 | 7813 |
| HUMTEN_PEA_1_T18 (SEQ ID NO: 865) | 5327 | 5378 |

TABLE 116-continued

Segment location on transcripts

| Transcript name | Segment starting position | Segment ending position |
|---|---|---|
| HUMTEN_PEA_1_T19 (SEQ ID NO: 866) | 5054 | 5105 |
| HUMTEN_PEA_1_T20 (SEQ ID NO. 867) | 6706 | 6757 |

Segment cluster HUMTEN_PEA_1_node_85 (SEQ ID NO: 929) according to the present invention is supported by 168 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866) and HUMTEN_PEA_1_T20 (SEQ ID NO. 867). Table 117 below describes the starting and ending position of this segment on each transcript.

TABLE 117

Segment location on transcripts

| Transcript name | Segment starting position | Segment ending position |
|---|---|---|
| HUMTEN_PEA_1_T4 (SEQ ID NO: 857) | 7293 | 7350 |
| HUMTEN_PEA_1_T5 (SEQ ID NO: 858) | 11500 | 11557 |
| HUMTEN_PEA_1_T6 (SEQ ID NO: 859) | 8594 | 8651 |
| HUMTEN_PEA_1_T7 (SEQ ID NO: 860) | 6744 | 6801 |
| HUMTEN_PEA_1_T11 (SEQ ID NO: 861) | 6744 | 6801 |
| HUMTEN_PEA_1_T14 (SEQ ID NO: 862) | 6198 | 6255 |
| HUMTEN_PEA_1_T16 (SEQ ID NO: 863) | 5925 | 5982 |
| HUMTEN_PEA_1_T17 (SEQ ID NO: 864) | 7814 | 7871 |
| HUMTEN_PEA_1_T18 (SEQ ID NO: 865) | 5379 | 5436 |
| HUMTEN_PEA_1_T19 (SEQ ID NO: 866) | 5106 | 5163 |
| HUMTEN_PEA_1_T20 (SEQ ID NO. 867) | 6758 | 6815 |

Segment cluster HUMTEN_PEA_1_node_86 (SEQ ID NO: 930) according to the present invention is supported by 179 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866) and HUMTEN_PEA_1_T20 (SEQ ID NO. 867). Table 118 below describes the starting and ending position of this segment on each transcript.

TABLE 118

Segment location on transcripts

| Transcript name | Segment starting position | Segment ending position |
|---|---|---|
| HUMTEN_PEA_1_T4 (SEQ ID NO: 857) | 7351 | 7441 |
| HUMTEN_PEA_1_T5 (SEQ ID NO: 858) | 11558 | 11648 |
| HUMTEN_PEA_1_T6 (SEQ ID NO: 859) | 8652 | 8742 |
| HUMTEN_PEA_1_T7 (SEQ ID NO: 860) | 6802 | 6892 |
| HUMTEN_PEA_1_T11 (SEQ ID NO: 861) | 6802 | 6892 |
| HUMTEN_PEA_1_T14 (SEQ ID NO: 862) | 6256 | 6346 |
| HUMTEN_PEA_1_T16 (SEQ ID NO: 863) | 5983 | 6073 |
| HUMTEN_PEA_1_T17 (SEQ ID NO: 864) | 7872 | 7962 |
| HUMTEN_PEA_1_T18 (SEQ ID NO: 865) | 5437 | 5527 |
| HUMTEN_PEA_1_T19 (SEQ ID NO: 866) | 5164 | 5254 |
| HUMTEN_PEA_1_T20 (SEQ ID NO. 867) | 6816 | 6906 |

Segment cluster HUMTEN_PEA_1_node_87 (SEQ ID NO: 931) according to the present invention is supported by 167 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866) and HUMTEN_PEA_1_T20 (SEQ ID NO. 867). Table 119 below describes the starting and ending position of this segment on each transcript.

TABLE 119

Segment location on transcripts

| Transcript name | Segment starting position | Segment ending position |
|---|---|---|
| HUMTEN_PEA_1_T4 (SEQ ID NO: 857) | 7442 | 7499 |
| HUMTEN_PEA_1_T5 (SEQ ID NO: 858) | 11649 | 11706 |
| HUMTEN_PEA_1_T6 (SEQ ID NO: 859) | 8743 | 8800 |
| HUMTEN_PEA_1_T7 (SEQ ID NO: 860) | 6893 | 6950 |
| HUMTEN_PEA_1_T11 (SEQ ID NO: 861) | 6893 | 6950 |
| HUMTEN_PEA_1_T14 (SEQ ID NO: 862) | 6347 | 6404 |
| HUMTEN_PEA_1_T16 (SEQ ID NO: 863) | 6074 | 6131 |
| HUMTEN_PEA_1_T17 (SEQ ID NO: 864) | 7963 | 8020 |
| HUMTEN_PEA_1_T18 (SEQ ID NO: 865) | 5528 | 5585 |
| HUMTEN_PEA_1_T19 (SEQ ID NO: 866) | 5255 | 5312 |
| HUMTEN_PEA_1_T20 (SEQ ID NO. 867) | 6907 | 6964 |

Segment cluster HUMTEN_PEA_1_node_88 (SEQ ID NO: 932) according to the present invention is supported by 164 libraries. The number of libraries was determined as previously described. This segment can be found in the following transcript(s): HUMTEN_PEA_1_T4 (SEQ ID NO: 857), HUMTEN_PEA_1_T5 (SEQ ID NO: 858), HUMTEN_PEA_1_T6 (SEQ ID NO: 859), HUMTEN_PEA_1_T7 (SEQ ID NO: 860), HUMTEN_PEA_1_T11 (SEQ ID NO: 861), HUMTEN_PEA_1_T14 (SEQ ID NO: 862), HUMTEN_PEA_1_T16 (SEQ ID NO: 863), HUMTEN_PEA_1_T17 (SEQ ID NO: 864), HUMTEN_PEA_1_T18 (SEQ ID NO: 865), HUMTEN_PEA_1_T19 (SEQ ID NO: 866) and HUMTEN_PEA_1_T20 (SEQ ID NO. 867). Table 120 below describes the starting and ending position of this segment on each transcript.

TABLE 120

Segment location on transcripts

| Transcript name | Segment starting position | Segment ending position |
|---|---|---|
| HUMTEN_PEA_1_T4 (SEQ ID NO: 857) | 7500 | 7558 |
| HUMTEN_PEA_1_T5 (SEQ ID NO: 858) | 11707 | 11765 |
| HUMTEN_PEA_1_T6 (SEQ ID NO: 859) | 8801 | 8859 |
| HUMTEN_PEA_1_T7 (SEQ ID NO: 860) | 6951 | 7009 |
| HUMTEN_PEA_1_T11 (SEQ ID NO: 861) | 6951 | 7009 |
| HUMTEN_PEA_1_T14 (SEQ ID NO: 862) | 6405 | 6463 |
| HUMTEN_PEA_1_T16 (SEQ ID NO: 863) | 6132 | 6190 |
| HUMTEN_PEA_1_T17 (SEQ ID NO: 864) | 8021 | 8079 |
| HUMTEN_PEA_1_T18 (SEQ ID NO: 865) | 5586 | 5644 |
| HUMTEN_PEA_1_T19 (SEQ ID NO: 866) | 5313 | 5371 |
| HUMTEN_PEA_1_T20 (SEQ ID NO. 867) | 6965 | 7023 |

Variant protein alignment to the previously known protein:

Sequence name: TENA_HUMAN_V1

Sequence documentation:

Alignment of: HUMTEN_PEA_1_P5 (SEQ ID NO: 934) x TENA_HUMAN_V1 . . .

Alignment segment 1/1:

Quality: 21611.00

Escore: 0

Matching length: 2201 Total length: 2293

Matching Percent Similarity: 100.00 Matching Percent

Identity: 100.00

Total Percent Similarity: 95.99 Total Percent

Identity: 95.99

Gaps: 1

Alignment:

```
  1  MGAMTQLLQGVFLAFLALATEGGVLKKVIRHKRQSGVNATLPEENQPVVF   50
     ||||||||| ||||||||||||||||||||||||||||||||||||||||
  1  MGAMTQLLAGVFLAFLALATEGGVLKKVIRHKRQSGVNATLPEENQPVVF   50

51  NHVYNIKLPVGSQCSVDLESASGEKDLAPPSEPSESFQEHTVDGENQIVF  100
     ||||||||||||||||||||||||||||||||||||||||||||||||||
 51  NHVYNIKLPVGSQCSVDLESASGEKDLAPPSEPSESFQEHTVDGENQIVF  100

101  THRINIPRRACGCAAAPDVKELLSRLEELENLVSSLREQCTAGAGCCLQP  150
     ||||||||||||||||||||||||||||||||||||||||||||||||||
101  THRINIPRRACGCAAAPDVKELLSRLEELENLVSSLREQCTAGAGCCLQP  150

151  ATGRLDTRPFCSGRGNFSTEGCGCVCEPGWKGPNCSEPECPGNCHLRGRC  200
     ||||||||||||||||||||||||||||||||||||||||||||||||||
151  ATGRLDTRPFCSGRGNFSTEGCGCVCEPGWKGPNCSEPECPGNCHLRGRC  200

201  IDGQCICDDGFTGEDCSQLACPSDCNDQGKCVNGVCICFEGYAGADCSRE  250
     ||||||||||||||||||||||||||||||||||||||||||||||||||
201  IDGQCICDDGFTGEDCSQLACPSDCNDQGKCVNGVCICFEGYAGADCSRE  250

251  ICPVPCSEEHGTCVDGLCVCHDGFAGDDCNKPLCLNNCYNRGRCVENECV  300
     ||||||||||||||||||||||||||||||||||||||||||||||||||
251  ICPVPCSEEHGTCVDGLCVCHDGFAGDDCNKPLCLNNCYNRGRCVENECV  300

301  CDEGFTGEDCSELICPNDCFDRGRCINGTCYCEEGFTGEDCGKPTCPHAC  350
     ||||||||||||||||||||||||||||||||||||||||||||||||||
301  CDEGFTGEDCSELICPNDCFDRGRCINGTCYCEEGFTGEDCGKPTCPHAC  350

351  HTQGRCEEGQCVCDEGFAGVDCSEKRCPADCHNRGRCVDGRCECDDGFTG  400
     ||||||||||||||||||||||||||||||||||||||||||||||||||
351  HTQGRCEEGQCVCDEGFAGVDCSEKRCPADCHNRGRCVDGRCECDDGFTG  400

401  ADCGELKCPNGCSGHGRCVNGQCVCDEGYTGEDCSQLRCPNDCHSRGRCV  450
     ||||||||||||||||||||||||||||||||||||||||||||||||||
401  ADCGELKCPNGCSGHGRCVNGQCVCDEGYTGEDCSQLRCPNDCHSRGRCV  450

451  EGKCVCEQGFKGYDCSDMSCPNDCHQGRCVNGMCVCDDGYTGEDCRDRQ  500
     |||||||||||||||||||||||||||||||||||||||||||| ||||
451  EGKCVCEQGFKGYDCSDMSCPNDCHQGRCVNGMCVCDDGYTGEDCTDRQ  500

501  CPRDCSNRGLCVDGQCVCEDGFTGPDCAELSCPNDCHGRGRCVNGQCVCH  550
     ||||||||||||||||||||||||||||||||||||||||||||||||||
501  CPRDCSNRGLCVDGQCVCEDGFTGPDCAELSCPNDCHGRGRCVNGQCVCH  550

551  EGFMGKDCKEQRCPSDCHGQGRCVDGQCICHEGFTGLDCGQHSCPSDCNN  600
     ||||||||||||||||||||||||||||||||||||||||||||||||||
551  EGFMGKDCKEQRCPSDCHGQGRCVDGQCICHEGFTGLDCGQHSCPSDCNN  600

601  LGQCVSGRCICNEGYSGEDCSEVSPPKDLVVTEVTEETVNLAWDNEMRVT  650
     ||||||||||||||||||||||||||||||||||||||||||||||||||
601  LGQCVSGRCICNEGYSGEDCSEVSPPKDLVVTEVTEETVNLAWDNEMRVT  650

651  EYLVVYTPTHEGGLEMQFRVPGDQTSTIIQELEPGVEYFIRVFAILENKK  700
     ||||||||||||||||||||||||||||||||||||||||||||||||||
651  EYLVVYTPTHEGGLEMQFRVPGDQTSTIIQELEPGVEYFIRVFAILENKK  700

701  SIPVSARVATYLPAPEGLKFKSIKETSVEVEWDPLDIAFETWEIIFRNMN  750
     ||||||||||||||||||||||||||||||||||||||||||||||||||
701  SIPVSARVATYLPAPEGLKFKSIKETSVEVEWDPLDIAFETWEIIFRNMN  750

751  KEDEGEITKSLRRPETSYRQTGLAPGQEYEISLHIVKNNTRGPGLKRVTT  800
     ||||||||||||||||||||||||||||||||||||||||||||||||||
751  KEDEGEITKSLRRPETSYRQTGLAPGQEYEISLHIVKNNTRGPGLKRVTT  800

801  TRLDAPSQIEVKDVTDTTALITWFKPLAEIDGIELTYGIKDVPGDRTTID  850
     ||||||||||||||||||||||||||||||||||||||||||||||||||
801  TRLDAPSQIEVKDVTDTTALITWFKPLAEIDGIELTYGIKDVPGDRTTID  850

851  LTEDENQYSIGNLKPDTEYEVSLISRRGDMSSNPAKETFTTGLDAPRNLR  900
     ||||||||||||||||||||||||||||||||||||||||||||||||||
851  LTEDENQYSIGNLKPDTEYEVSLISRRGDMSSNPAKETFTTGLDAPRNLR  900

901  RVSQTDNSITLEWRNGKAAIDSYRIKYAPISGGDHAEVDVPKSQQATTKT  950
     ||||||||||||||||||||||||||||||||||||||||||||||||||
901  RVSQTDNSITLEWRNGKAAIDSYRIKYAPISGGDHAEVDVPKSQQATTKT  950

951  TLTGLRPGTEYGIGVSAVKEDKESNPATINAATELDTPKDLQVSETAETS 1000
     ||||||||||||||||||||||||||||||||||||||||||||||||||
951  TLTGLRPGTEYGIGVSAVKEDKESNPATINAATELDTPKDLQVSETAETS 1000
```

-continued

```
1001  LTLLWKTPLAKFDRYRLNYSLPTGQWVGVQLPRNTTSYVLRGLEPGQEYN  1050
      ||||||||||||||||||||||||||||||||||||||||||||||||||
1001  LTLLWKTPLAKFDRYRLNYSLPTGQWVGVQLPRNTTSYVLRGLEPGQEYN  1050

1051  VLLTAEKGRHKSKPARVKASTEQAPELENLTVTEVGWDGLRLNWTAADQA  1100
      ||||||||||||||||||||||||||||||||||||||||||||||||||
1051  VLLTAEKGRHKSKPARVKASTEQAPELENLTVTEVGWDGLRLNWTAADQA  1100

1101  YEHFIIQVQEANKVEAARNLTVPGSLRAVDIPGLKAATPYTVSIYGVIQG  1150
      ||||||||||||||||||||||||||||||||||||||||||||||||||
1101  YEHFIIQVQEANKVEAARNLTVPGSLRAVDIPGLKAATPYTVSIYGVIQG  1150

1151  YRTPVLSAEASTGETPNLGEVVVAEVGWDALKLNWTAPEGAYEYFFIQVQ  1200
      ||||||||||||||||||||||||||||||||||||||||||||||||||
1151  YRTPVLSAEASTGETPNLGEVVVAEVGWDALKLNWTAPEGAYEYFFIQVQ  1200

1201  EADTVEAAQNLTVPGGLRSTDLPGLKAATHYTITIRGVTQDFSTTPLSVE  1250
      ||||||||||||||||||||||||||||||||||||||||||||||||||
1201  EADTVEAAQNLTVPGGLRSTDLPGLKAATHYTITIRGVTQDFSTTPLSVE  1250

1251  VLTEEVPDMGNLTVTEVSWDALRLNWTTPDGTYDQFTIQVQEADQVEEAH  1300
      ||||||||||||||||||||||||||||||||||||||||||||||||||
1251  VLTEEVPDMGNLTVTEVSWDALRLNWTTPDGTYDQFTIQVQEADQVEEAH  1300

1301  NLTVPGSLRSMEIPGLRAGTPYTVTLHGEVRGHSTRPLAVEVVTEDLPQL  1350
      ||||||||||||||||||||||||||||||||||||||||||||||||||
1301  NLTVPGSLRSMEIPGLRAGTPYTVTLHGEVRGHSTRPLAVEVVTEDLPQL  1350

1351  GDLAVSEVGWDGLRLNWTAADNAYEHFVIQVQEVNKVEAAQNLTLPGSLR  1400
      ||||||||||||||||||||||||||||||||||||||||||||||||||
1351  GDLAVSEVGWDGLRLNWTAADNAYEHFVIQVQEVNKVEAAQNLTLPGSLR  1400

1401  AVDIPGLEAATPYRVSIYGVIRGYRTPVLSAEASTAKEPEIGNLNVSDIT  1450
      ||||||||||||||||||||||||||||||||||||||||||||||||||
1401  AVDIPGLEAATPYRVSIYGVIRGYRTPVLSAEASTAKEPEIGNLNVSDIT  1450

1451  PESFNLSWMATDGIFETFTIEIIDSNRLLETVEYNISGAERTAHISGLPP  1500
      ||||||||||||||||||||||||||||||||||||||||||||||||||
1451  PESFNLSWMATDGIFETFTIEIIDSNRLLETVEYNISGAERTAHISGLPP  1500

1501  STDFIVYLSGLAPSIRTKTISATATTEPKPQLGTLIFSNITPKSFNMSWT  1550
      |||||||||||||||||||||||||
1501  STDFIVYLSGLAPSIRTKTISATAT.........................  1525

1551  TQAGLFAKIVINVSDAHSLHESQQFTVSGDAKQAHITGLVENTGYDVSVA  1600

1525  ..................................................  1525

1601  GTTLAGDPTRPLTAFVITEALPLLENLTISDINPYGFTVSWMASENAFDS  1650
                      ||||||||||||||||||||||||||||||||||
1526  ................TEALPLLENLTISDINPYGFTVSWMASENAFDS  1558

1651  FLVTVVDSGKLLDPQEFTLSGTQRKLELRGLITGIGYEVMVSGFTQGHQT  1700
      ||||||||||||||||||||||||||||||||||||||||||||||||||
1559  FLVTVVDSGKLLDPQEFTLSGTQRKLELRGLITGIGYEVMVSGFTQGHQT  1608

1701  KPLRAEIVTEAEPEVDNLLVSDATPDGFRLSWTADEGVFDNFVLKIRDTK  1750
      ||||||||||||||||||||||||||||||||||||||||||||||||||
1609  KPLRAEIVTEAEPEVDNLLVSDATPDGFRLSWTADEGVFDNFVLKIRDTK  1658

1751  KQSEPLEITLLAPERTRDLTGLREATEYEIELYGISKGRRSQTVSAIATT  1800
      ||||||||||||||||||||||||||||||||||||||||||||||||||
1659  KQSEPLEITLLAPERTRDLTGLREATEYEIELYGISKGRRSQTVSAIATT  1708

1801  AMGSPKEVIFSDITENSATVSWRAPTAQVESFRITYVPITGGTPSMVTVD  1850
      ||||||||||||||||||||||||||||||||||||||||||||||||||
1709  AMGSPKEVIFSDITENSATVSWRAPTAQVESFRITYVPITGGTPSMVTVD  1758

1851  GTKTQTRLVKLIPGVEYLVSIIAMKGFEESEPVSGSFTTALDGPSGLVTA  1900
      ||||||||||||||||||||||||||||||||||||||||||||||||||
1759  GTKTQTRLVKLIPGVEYLVSIIAMKGFEESEPVSGSFTTALDGPSGLVTA  1808

1901  NITDSEALARWQPAIATVDSYVISYTGEKVPEITRTVSGNTVEYALTDLE  1950
      ||||||||||||||||||||||||||||||||||||||||||||||||||
1809  NITDSEALARWQPAIATVDSYVISYTGEKVPEITRTVSGNTVEYALTDLE  1858

1951  PATEYTLRIFAEKGPQKSSTITAKFTTDLDSPRDLTATEVQSETALLTWR  2000
      ||||||||||||||||||||||||||||||||||||||||||||||||||
1859  PATEYTLRIFAEKGPQKSSTITAKFTTDLDSPRDLTATEVQSETALLTWR  1908
```

-continued

```
2001  PPRASVTGYLLVYESVDGTVKEVIVGPDTTSYSLADLSPSTHYTAKIQAL  2050
      ||||||||||||||||||||||||||||||||||||||||||||||||||
1909  PPRASVTGYLLVYESVDGTVKEVIVGPDTTSYSLADLSPSTHYTAKIQAL  1958

2051  NGPLRSNMIQTIFTTIGLLYPRPKDCSQAMLNGDTTSGLYTIYLNGDKAQ  2100
      ||||||||||||||||||| ||||||||||||||||||||||||||||||
1959  NGPLRSNMIQTIFTTIGLLYPFPKDCSQAMLNGDTTSGLYTIYLNGDKAQ  2008

2101  ALEVFCDMTSDGGGWIVFLRRKNGRENFYQNWKAYAAGFGDRREEFWLGL  2150
      ||||||||||||||||||||||||||||||||||||||||||||||||||
2009  ALEVFCDMTSDGGGWIVFLRRKNGRENFYQNWKAYAAGFGDRREEFWLGL  2058

2151  DNLNKITAQGQYELRVDLRDHGETAFAVYDKFSVGDAKTRYKLKVEGYSG  2200
      ||||||||||||||||||||||||||||||||||||||||||||||||||
2059  DNLNKITAQGQYELRVDLRDHGETAFAVYDKFSVGDAKTRYKLKVEGYSG  2108

2201  TAGDSMAYHNGRSFSTFDKDTDSAITNCALSYKGAFWYRNCHRVNLMGRY  2250
      ||||||||||||||||||||||||||||||||||||||||||||||||||
2109  TAGDSMAYHNGRSFSTFDKDTDSAITNCALSYKGAFWYRNCHRVNLMGRY  2158

2251  GDNNHSQGVNWFHWKGHEHSIQFAEMKLRPSNFRNLEGRRKRA  2293
      ||||||||||||||||||||||||||||||||||||||||||
2159  GDNNHSQGVNWFHWKGHEHSIQFAEMKLRPSNFRNLEGRRKRA  2201
```

Sequence name: TENA_HUMAN_V1

Sequence documentation:

Alignment of: HUMTEN_PEA_1_P6 (SEQ ID NO: 935) x TENA_HUMAN_V1 . . .

Alignment segment 1/1:
 Quality: 15349.00

Escore: 0
 Matching length: 1603 Total length: 1603

Matching Percent Similarity: 97.75 Matching Percent Identity: 96.88

Total Percent Similarity: 97.75 Total Percent Identity: 96.88

Gaps: 0

Alignment:

```
  1  MGAMTQLLAGVFLAFLALATEGGVLKKVIRHKRQSGVNATLPEENQPVVF   50
     ||||||||| ||||||||||||||||||||||||||||||||||||||||
  1  MGAMTQLLQGVFLAFLALATEGGVLKKVIRHKRQSGVNATLPEENQPVVF   50

51  NHVYNIKLPVGSQCSVDLESASGEKDLAPPSEPSESFQEHTVDGENQIVF  100
     ||||||||||||||||||||||||||||||||||||||||||||||||||
 51  NHVYNIKLPVGSQCSVDLESASGEKDLAPPSEPSESFQEHTVDGENQIVF  100

101  THRINIPRRACGCAAAPDVKELLSRLEELENLVSSLREQCTAGAGCCLQP  150
     ||||||||||||||||||||||||||||||||||||||||||||||||||
101  THRINIPRRACGCAAAPDVKELLSRLEELENLVSSLREQCTAGAGCCLQP  150

151  ATGRLDTRPFCSGRGNFSTEGCGCVCEPGWKGPNCSEPECPGNCHLRGRC  200
     ||||||||||||||||||||||||||||||||||||||||||||||||||
551  EGFMGKDCKEQRCPSDCHGQGRCVDGQCICHEGFTGLDCGQHSCPSDCNN  600

601  LGQCVSGRCICNEGYSGEDCSEVSPPKDLVVTEVTEETVNLAWDNEMRVT  650
     ||||||||||||||||||||||||||||||||||||||||||||||||||
601  LGQCVSGRCICNEGYSGEDCSEVSPPKDLVVTEVTEETVNLAWDNEMRVT  650

651  EYLVVYTPTHEGGLEMQFRVPGDQTSTIIQELEPGVEYFIRVFAILENKK  700
     ||||||||||||||||||||||||||||||||||||||||||||||||||
651  EYLVVYTPTHEGGLEMQFRVPGDQTSTIIQELEPGVEYFIRVFAILENKK  700

701  SIPVSARVATYLPAPEGLKFKSIKETSVEVEWDPLDIAFETWEIIFRNMN  750
     ||||||||||||||||||||||||||||||||||||||||||||||||||
701  SIPVSARVATYLPAPEGLKFKSIKETSVEVEWDPLDIAFETWEIIFRNMN  750

751  KEDEGEITKSLRRPETSYRQTGLAPGQEYEISLHIVKNNTRGPGLKFVTT  800
     |||||||||||||||||||||||||||||||||||||||||||||| |||
751  KEDEGEITKSLRRPETSYRQTGLAPGQEYEISLHIVKNNTRGPGLKRVTT  800

801  TRLDAPSQIEVKDVTDTTALITWFKPLAEIDGIELTYGIKDVPGDRTTID  850
     ||||||||||||||||||||||||||||||||||||||||||||||||||
801  TRLDAPSQIEVKDVTDTTALITWFKPLAEIDGIELTYGIKDVPGDRTTID  850
```

```
 851  LTEDENQYSIGNLKPDTEYEVSLISRRGDMSSNPAKETFTTGLDAPRNLR   900
      ||||||||||||||||||||||||||||||||||||||||||||||||||
 851  LTEDENQYSIGNLKPDTEYEVSLISRRGDMSSNPAKETFTTGLDAPRNLR   900

901  RVSQTDNSITLEWRNGKAAIDSYRIKYAPISGGDHAEVDVPKSQQATTKT   950
      |||||||||||||||||||||||||||||||||||||||||||||||||
 901  RVSQTDNSITLEWRNGKAAIDSYRIKYAPISGGDHAEVDVPKSQQATTKT   950

951  TLTGLRPGTEYGIGVSAVKEDKESNPATINAATELDTPKDLQVSETAETS  1000
      |||||||||||||||||||||||||||||||||||||||||||||||||
 951  TLTGLRPGTEYGIGVSAVKEDKESNPATINAATELDTPKDLQVSETAETS  1000

1001  LTLLWKTPLAKFDRYRLNYSLPTGQWVGVQLPRNTTSYVLRGLEPGQEYN  1050
      |||||||||||||||||||||||||||||||||||||||||||||||||
1001  LTLLWKTPLAKFDRYRLNYSLPTGQWVGVQLPRNTTSYVLRGLEPGQEYN  1050

1051  VLLTAEKGRHKSKPARVKASTEQAPELENLTVTEVGWDGLRLNWTAADQA  1100
      |||||||||||||||||||||||||||||||||||||||||||||||||
1051  VLLTAEKGRHKSKPARVKASTEQAPELENLTVTEVGWDGLRLNWTAADQA  1100

1101  YEHFIIQVQEANKVEAARNLTVPGSLRAVDIPGLKAATPYTVSIYGVIQG  1150
      |||||||||||||||||||||||||||||||||||||||||||||||||
1101  YEHFIIQVQEANKVEAARNLTVPGSLRAVDIPGLKAATPYTVSIYGVIQG  1150

1151  YRTPVLSAEASTGETPNLGEVVVAEVGWDALKLNWTAPEGAYEYFFIQVQ  1200
      |||||||||||||||||||||||||||||||||||||||||||||||||
1151  YRTPVLSAEASTGETPNLGEVVVAEVGWDALKLNWTAPEGAYEYFFIQVQ  1200

1201  EADTVEAAQNLTVPGGLRSTDLPGLKAATHYTITIRGVTQDFSTTPLSVE  1250
      |||||||||||||||||||||||||||||||||||||||||||||||||
1201  EADTVEAAQNLTVPGGLRSTDLPGLKAATHYTITIRGVTQDFSTTPLSVE  1250

1251  VLTEEVPDMGNLTVTEVSWDALRLNWTTPDGTYDQFTIQVQEADQVEEAH  1300
      |||||||||||||||||||||||||||||||||||||||||||||||||
1251  VLTEEVPDMGNLTVTEVSWDALRLNWTTPDGTYDQFTIQVQEADQVEEAH  1300

1301  NLTVPGSLRSMEIPGLRAGTPYTVTLHGEVRGHSTRPLAVEVVTEDLPQL  1350
      |||||||||||||||||||||||||||||||||||||||||||||||||
1301  NLTVPGSLRSMEIPGLRAGTPYTVTLHGEVRGHSTRPLAVEVVTEDLPQL  1350

1351  GDLAVSEVGWDGLRLNWTAADNAYEHFVIQVQEVNKVEAAQNLTLPGSLR  1400
      |||||||||||||||||||||||||||||||||||||||||||||||||
1351  GDLAVSEVGWDGLRLNWTAADNAYEHFVIQVQEVNKVEAAQNLTLPGSLR  1400

1401  AVDIPGLEAATPYRVSIYGVIRGYRTPVLSAEASTAKEPEIGNLNVSDIT  1450
      |||||||||||||||||||||||||||||||||||||||||||||||||
1401  AVDIPGLEAATPYRVSIYGVIRGYRTPVLSAEASTAKEPEIGNLNVSDIT  1450

1451  PESFNLSWMATDGIFETFTIEIIDSNRLLETVEYNISGAERTAHISGLPP  1500
      |||||||||||||||||||||||||||||||||||||||||||||||||
1451  PESFNLSWMATDGIFETFTIEIIDSNRLLETVEYNISGAERTAHISGLPP  1500

1501  STDFIVYLSGLAPSIRTKTISATATTEPKPQLGTLIFSNITPKSFNMSWT  1550
      |||||||||||||||||||||||| |   |   |:|    |   :||
1501  STDFIVYLSGLAPSIRTKTISATATTEALPLLENLTISDINPYGFTVSWM  1550

1551  TQAGLFAKIVINVSDAHSLHESQQFTVSGDAKQAHITGLVENTGYDVSVA  1600
        |   ::  ||:   |  :  |:||:||   ::   ||:    ||:|  |:
1551  ASENAFDSFLVTVVDSGKLLDPQEFTLSGTQRKLELRGLITGIGYEVMVS  1600

1601  GTT   1603
      | |
1601  GFT   1603
```

Sequence name: TENA_HUMAN_V1   length: 1617

Sequence documentation:

Alignment of: HUMTEN_PEA_1_P7 (SEQ ID NO: 936) x TENA_HUMAN_V1 . . .

Alignment segment 1/1:
  Quality: 16042.00

Escore: 0
  Matching length: 1617 Total

Matching Percent Similarity: 100.00 Matching Percent

Identity: 100.00
  Total Percent Similarity: 100.00 Total Percent

Identity: 100.00
  Gaps: 0

Alignment:

```
  1 MGAMTQLLQGVFLAFLALATEGGVLKKVIRHKRQSGVNATLPEENQPVVF   50
    ||||||||| ||||||||||||||||||||||||||||||||||||||||
  1 MGAMTQLLAGVFLAFLALATEGGVLKKVIRHKRQSGVNATLPEENQPVVF   50

51 NHVYNIKLPVGSQCSVDLESASGEKDLAPPSEPSESFQEHTVDGENQIVF  100
    ||||||||||||||||||||||||||||||||||||||||||||||||||
 51 NHVYNIKLPVGSQCSVDLESASGEKDLAPPSEPSESFQEHTVDGENQIVF  100

101 THRINIPRRACGCAAAPDVKELLSRLEELENLVSSLREQCTAGAGCCLQP  150
    ||||||||||||||||||||||||||||||||||||||||||||||||||
101 THRINIPRRACGCAAAPDVKELLSRLEELENLVSSLREQCTAGAGCCLQP  150

151 ATGRLDTRPFCSGRGNFSTEGCGCVCEPGWKGPNCSEPECPGNCHLRGRC  200
    ||||||||||||||||||||||||||||||||||||||||||||||||||
151 ATGRLDTRPFCSGRGNFSTEGCGCVCEPGWKGPNCSEPECPGNCHLRGRC  200

201 IDGQCICDDGFTGEDCSQLACPSDCNDQGKCVNGVCICFEGYAGADCSRE  250
    ||||||||||||||||||||||||||||||||||||||||||||||||||
201 IDGQCICDDGFTGEDCSQLACPSDCNDQGKCVNGVCICFEGYAGADCSRE  250

251 ICPVPCSEEHGTCVDGLCVCHDGFAGDDCNKPLCLNNCYNRGRCVENECV  300
    ||||||||||||||||||||||||||||||||||||||||||||||||||
251 ICPVPCSEEHGTCVDGLCVCHDGFAGDDCNKPLCLNNCYNRGRCVENECV  300

301 CDEGFTGEDCSELICPNDCFDRGRCINGTCYCEEGFTGEDCGKPTCPHAC  350
    ||||||||||||||||||||||||||||||||||||||||||||||||||
301 CDEGFTGEDCSELICPNDCFDRGRCINGTCYCEEGFTGEDCGKPTCPHAC  350

351 HTQGRCEEGQCVCDEGFAGVDCSEKRCPADCHNRGRCVDGRCECDDGFTG  400
    ||||||||||||||||||||||||||||||||||||||||||||||||||
351 HTQGRCEEGQCVCDEGFAGVDCSEKRCPADCHNRGRCVDGRCECDDGFTG  400

401 ADCGELKCPNGCSGHGRCVNGQCVCDEGYTGEDCSQLRCPNDCHSRGRCV  450
    ||||||||||||||||||||||||||||||||||||||||||||||||||
401 ADCGELKCPNGCSGHGRCVNGQCVCDEGYTGEDCSQLRCPNDCHSRGRCV  450

451 EGKCVCEQGFKGYDCSDMSCPNDCHQGRCVNGMCVCDDGYTGEDCRDRQ   500
    |||||||||||||||||||||||||||||||||||||||||||||| |
451 EGKCVCEQGFKGYDCSDMSCPNDCHQGRCVNGMCVCDDGYTGEDCTDRQ   500

501 CPRDCSNRGLCVDGQCVCEDGFTGPDCAELSCPNDCHGRGRCVNGQCVCH  550
    ||||||||||||||||||||||||||||||||||||||||||||||||||
501 CPRDCSNRGLCVDGQCVCEDGFTGPDCAELSCPNDCHGRGRCVNGQCVCH  550

551 EGFMGKDCKEQRCPSDCHGQGRCVDGQCICHEGFTGLDCGQHSCPSDCNN  600
    ||||||||||||||||||||||||||||||||||||||||||||||||||
551 EGFMGKDCKEQRCPSDCHGQGRCVDGQCICHEGFTGLDCGQHSCPSDCNN  600

601 LGQCVSGRCICNEGYSGEDCSEVSPPKDLVVTEVTEETVNLAWDNEMRVT  650
    ||||||||||||||||||||||||||||||||||||||||||||||||||
601 LGQCVSGRCICNEGYSGEDCSEVSPPKDLVVTEVTEETVNLAWDNEMRVT  650

651 EYLVVYTPTHEGGLEMQFRVPGDQTSTIIQELEPGVEYFIRVFAILENKK  700
    ||||||||||||||||||||||||||||||||||||||||||||||||||
651 EYLVVYTPTHEGGLEMQFRVPGDQTSTIIQELEPGVEYFIRVFAILENKK  700

701 SIPVSARVATYLPAPEGLKFKSIKETSVEVEWDPLDIAFETWEIIFRNMN  750
    ||||||||||||||||||||||||||||||||||||||||||||||||||
701 SIPVSARVATYLPAPEGLKFKSIKETSVEVEWDPLDIAFETWEIIFRNMN  750

751 KEDEGEITKSLRRPETSYRQTGLAPGQEYEISLHIVKNNTRGPGLKRVTT  800
    ||||||||||||||||||||||||||||||||||||||||||||||||||
751 KEDEGEITKSLRRPETSYRQTGLAPGQEYEISLHIVKNNTRGPGLKRVTT  800

801 TRLDAPSQIEVKDVTDTTALITWFKPLAEIDGIELTYGIKDVPGDRTTID  850
    ||||||||||||||||||||||||||||||||||||||||||||||||||
801 TRLDAPSQIEVKDVTDTTALITWFKPLAEIDGIELTYGIKDVPGDRTTID  850

851 LTEDENQYSIGNLKPDTEYEVSLISRRGDMSSNPAKETFTTGLDAPRNLR  900
    ||||||||||||||||||||||||||||||||||||||||||||||||||
851 LTEDENQYSIGNLKPDTEYEVSLISRRGDMSSNPAKETFTTGLDAPRNLR  900

901 RVSQTDNSITLEWRNGKAAIDSYRIKYAPISGGDHAEVDVPKSQQATTKT  950
    ||||||||||||||||||||||||||||||||||||||||||||||||||
901 RVSQTDNSITLEWRNGKAAIDSYRIKYAPISGGDHAEVDVPKSQQATTKT  950

951 TLTGLRPGTEYGIGVSAVKEDKESNPATINAATELDTPKDLQVSETAETS 1000
    ||||||||||||||||||||||||||||||||||||||||||||||||||
951 TLTGLRPGTEYGIGVSAVKEDKESNPATINAATELDTPKDLQVSETAETS 1000
```

-continued

```
1001  LTLLWKTPLAKFDRYRLNYSLPTGQWVGVQLPRNTTSYVLRGLEPGQEYN  1050
      ||||||||||||||||||||||||||||||||||||||||||||||||||
1001  LTLLWKTPLAKFDRYRLNYSLPTGQWVGVQLPRNTTSYVLRGLEPGQEYN  1050

1051  VLLTAEKGRHKSKPARVKASTEQAPELENLTVTEVGWDGLRLNWTAADQA  1100
      ||||||||||||||||||||||||||||||||||||||||||||||||||
1051  VLLTAEKGRHKSKPARVKASTEQAPELENLTVTEVGWDGLRLNWTAADQA  1100

1101  YEHFIIQVQEANKVEAARNLTVPGSLRAVDIPGLKAATPYTVSIYGVIQG  1150
      ||||||||||||||||||||||||||||||||||||||||||||||||||
1101  YEHFIIQVQEANKVEAARNLTVPGSLRAVDIPGLKAATPYTVSIYGVIQG  1150

1151  YRTPVLSAEASTGETPNLGEVVVAEVGWDALKLNWTAPEGAYEYFFIQVQ  1200
      ||||||||||||||||||||||||||||||||||||||||||||||||||
1151  YRTPVLSAEASTGETPNLGEVVVAEVGWDALKLNWTAPEGAYEYFFIQVQ  1200

1201  EADTVEAAQNLTVPGGLRSTDLPGLKAATHYTITIRGVTQDFSTTPLSVE  1250
      ||||||||||||||||||||||||||||||||||||||||||||||||||
1201  EADTVEAAQNLTVPGGLRSTDLPGLKAATHYTITIRGVTQDFSTTPLSVE  1250

1251  VLTEEVPDMGNLTVTEVSWDALRLNWTTPDGTYDQFTIQVQEADQVEEAH  1300
      ||||||||||||||||||||||||||||||||||||||||||||||||||
1251  VLTEEVPDMGNLTVTEVSWDALRLNWTTPDGTYDQFTIQVQEADQVEEAH  1300

1301  NLTVPGSLRSMEIPGLRAGTPYTVTLHGEVRGHSTRPLAVEVVTEDLPQL  1350
      ||||||||||||||||||||||||||||||||||||||||||||||||||
1301  NLTVPGSLRSMEIPGLRAGTPYTVTLHGEVRGHSTRPLAVEVVTEDLPQL  1350

1351  GDLAVSEVGWDGLRLNWTAADNAYEHFVIQVQEVNKVEAAQNLTLPGSLR  1400
      ||||||||||||||||||||||||||||||||||||||||||||||||||
1351  GDLAVSEVGWDGLRLNWTAADNAYEHFVIQVQEVNKVEAAQNLTLPGSLR  1400

1401  AVDIPGLEAATPYRVSIYGVIRGYRTPVLSAEASTAKEPEIGNLNVSDIT  1450
      ||||||||||||||||||||||||||||||||||||||||||||||||||
1401  AVDIPGLEAATPYRVSIYGVIRGYRTPVLSAEASTAKEPEIGNLNVSDIT  1450

1451  PESFNLSWMATDGIFETFTIEIIDSNRLLETVEYNISGAERTAHISGLPP  1500
      ||||||||||||||||||||||||||||||||||||||||||||||||||
1451  PESFNLSWMATDGIFETFTIEIIDSNRLLETVEYNISGAERTAHISGLPP  1500

1501  STDFIVYLSGLAPSIRTKTISATATTEALPLLENLTISDINPYGFTVSWM  1550
      ||||||||||||||||||||||||||||||||||||||||||||||||||
1501  STDFIVYLSGLAPSIRTKTISATATTEALPLLENLTISDINPYGFTVSWM  1550

1551  ASENAFDSFLVTVVDSGKLLDPQEFTLSGTQRKLELRGLITGIGYEVMVS  1600
      ||||||||||||||||||||||||||||||||||||||||||||||||||
1551  ASENAFDSFLVTVVDSGKLLDPQEFTLSGTQRKLELRGLITGIGYEVMVS  1600

1601  GFTQGHQTKPLRAEIVT                                  1617
      |||||||||||||||||
1601  GFTQGHQTKPLRAEIVT                                  1617
```

Sequence name: TENA_HUMAN_V1

Sequence documentation:

Alignment of: HUMTEN_PEA_1_P8 (SEQ ID NO: 937) x TENA_HUMAN_V1 . . .

Alignment segment 1/1:
  Quality: 20743.00
Escore: 0
  Matching length: 2110 Total length: 2201

Matching Percent Similarity: 100.00 Matching Percent Identity: 100.00

Total Percent Similarity: 95.87 Total Percent Identity: 95.87

Gaps: 1

Alignment:

```
  1  MGAMTQLLAGVFLAFLALATEGGVLKKVIRHKRQSGVNATLPEENQPVVF   50
     ||||||||||||||||||||||||||||||||||||||||||||||||||
  1  MGAMTQLLAGVFLAFLALATEGGVLKKVIRHKRQSGVNATLPEENQPVVF   50

51  NHVYNIKLPVGSQCSVDLESASGEKDLAPPSEPSESFQEHTVDGENQIVF  100
     ||||||||||||||||||||||||||||||||||||||||||||||||||
 51  NHVYNIKLPVGSQCSVDLESASGEKDLAPPSEPSESFQEHTVDGENQIVF  100
```

-continued

```
 101  THRINIPRRACGCAAAPDVKELLSRLEELENLVSSLREQCTAGAGCCLQP   150
      ||||||||||||||||||||||||||||||||||||||||||||||||||
 101  THRINIPRRACGCAAAPDVKELLSRLEELENLVSSLREQCTAGAGCCLQP   150

151  ATGRLDTRPFCSGRGNFSTEGCGCVCEPGWKGPNCSEPECPGNCHLRGRC   200
      ||||||||||||||||||||||||||||||||||||||||||||||||||
 151  ATGRLDTRPFCSGRGNFSTEGCGCVCEPGWKGPNCSEPECPGNCHLRGRC   200

201  IDGQCICDDGFTGEDCSQLACPSDCNDQGKCVNGVCICFEGYAGADCSRE   250
      ||||||||||||||||||||||||||||||||||||||||||||||||||
 201  IDGQCICDDGFTGEDCSQLACPSDCNDQGKCVNGVCICFEGYAGADCSRE   250

251  ICPVPCSEEHGTCVDGLCVCHDGFAGDDCNKPLCLNNCYNRGRCVENECV   300
      ||||||||||||||||||||||||||||||||||||||||||||||||||
 251  ICPVPCSEEHGTCVDGLCVCHDGFAGDDCNKPLCLNNCYNRGRCVENECV   300

301  CDEGFTGEDCSELICPNDCFDRGRCINGTCYCEEGFTGEDCGKPTCPHAC   350
      ||||||||||||||||||||||||||||||||||||||||||||||||||
 301  CDEGFTGEDCSELICPNDCFDRGRCINGTCYCEEGFTGEDCGKPTCPHAC   350

351  HTQGRCEEGQCVCDEGFAGVDCSEKRCPADCKNRGRCVDGRCECDDGFTG   400
      ||||||||||||||||||||||||||||||||||||||||||||||||||
 351  HTQGRCEEGQCVCDEGFAGVDCSEKRCPADCHNRGRCVDGRCECDDGFTG   400

401  ADCGELKCPNGCSGHGRCVNGQCVCDEGYTGEDCSQLRCPNDCHSRGRCV   450
      ||||||||||||||||||||||||||||||||||||||||||||||||||
 401  ADCGELKCPNGCSGHGRCVNGQCVCDEGYTGEDCSQLRCPNDCHSRGRCV   450

451  EGKCVCEQGFKGYDCSDMSCPNDCHQHGRCVNGMCVCDDGYTGEDCRDRQ   500
      ||||||||||||||||||||||||||||||||||||||||||||||||||
 451  EGKCVCEQGFKGYDCSDMSCPNDCHQHGRCVNGMCVCDDGYTGEDCRDRQ   500

501  CPRDCSNRGLCVDGQCVCEDGFTGPDCAELSCPNDCHGRGRCVNGQCVCH   550
      ||||||||||||||||||||||||||||||||||||||||||||||||||
 501  CPRDCSNRGLCVDGQCVCEDGFTGPDCAELSCPNDCHGRGRCVNGQCVCH   550

551  EGFMGKDCKEQRCPSDCHGQGRCVDGQCICHEGFTGLDCGQHSCPSDCNN   600
      ||||||||||||||||||||||||||||||||||||||||||||||||||
 551  EGFMCKDCKEQRCPSDCHGQGRCVDGQCICHEGFTGLDCGQHSCPSDCNN   600

601  LGQCVSGRCICNEGYSGEDCSEVSPPKDLVVTEVTEETVNLAWDNEMRVT   650
      ||||||||||||||||||||||||||||||||||||||||||||||||||
 601  LGQCVSGRCICNEGYSGEDCSEVSPPKDLVVTEVTEETVNLAWDNEMRVT   650

651  EYLVVYTPTHEGGLEMQFRVPGDQTSTIIQELEPGVEYFIRVFAILENKK   700
      ||||||||||||||||||||||||||||||||||||||||||||||||||
 651  EYLVVYTPTHEGGLEMQFRVPGDQTSTIIQELEPGVEYFIRVFAILENKK   700

701  SIPVSARVATYLPAPEGLKFKSIKETSVEVEWDPLDIAFETWEIIFRNMN   750
      ||||||||||||||||||||||||||||||||||||||||||||||||||
 701  SIPVSARVATYLPAPEGLKFKSIKETSVEVEWDPLDIAFETWEIIFRNMN   750

751  KEDEGEITKSLRRPETSYRQTGLAPGQEYEISLHIVKNNTRGPGLKRVTT   800
      ||||||||||||||||||||||||||||||||||||||||||||||||||
 751  KEDEGEITKSLRRPETSYRQTGLAPGQEYEISLHIVKNNTRGPGLKRVTT   800

801  TRLDAPSQIEVKDVTDTTALITWFKPLAEIDGIELTYGIKDVPGDRTTID   850
      ||||||||||||||||||||||||||||||||||||||||||||||||||
 801  TRLDAPSQIEVKDVTDTTALITWFKPLAEIDGIELTYGIKDVPGDRTTID   850

851  LTEDENQYSIGNLKPDTEYEVSLISRRGDMSSNPAKETFTTGLDAPRNLR   900
      ||||||||||||||||||||||||||||||||||||||||||||||||||
 851  LTEDENQYSIGNLKPDTEYEVSLISRRGDMSSNPAKETFTTGLDAPRNLR   900

901  RVSQTDNSITLEWRNGKAAIDSYRIKYAPISGGDHAEVDVPKSQQATTKT   950
      ||||||||||||||||||||||||||||||||||||||||||||||||||
 901  RVSQTDNSITLEWRNGKAAIDSYRIKYAPISGGDHAEVDVPKSQQATTKT   950

951  TLTGLRPGTEYGIGVSAVKEDKESNPATINAATELDTPKDLQVSETAETS  1000
      ||||||||||||||||||||||||||||||||||||||||||||||||||
 951  TLTGLRPGTEYGIGVSAVKEDKESNPATINAATELDTPKDLQVSETAETS  1000

1001  LTLLWKTPLAKFDRYRLNYSLPTGQWVGVQLPRNTTSYVLRGLEPGQEYN  1050
      ||||||||||||||||||||||||||||||||||||||||||||||||||
1001  LTLLWKTPLAKFDRYRLNYSLPTGQWVGVQLPRNTTSYVLRGLEPGQEYN  1050

1051  VLLTAEKGRHKSKPARVKASTEQAPELENLTVTEVGWDGLRLNWTAADQA  1100
      ||||||||||||||||||||||||||||||||||||||||||||||||||
1051  VLLTAEKGRHKSKPARVKASTEQARELENLTVTEVGWDGLRLNWTAADQA  1100
```

-continued

```
1101  YEHFIIQVQEANKVEAARNLTVPGSLRAVDIPGLKAATPYTVSIYGVIQG  1150
      ||||||||||||||||||||||||||||||||||||||||||||||||||
1101  YEHFIIQVQEANKVEAARNLTVPGSLRAVDIPGLKAATPYTVSIYGVIQG  1150

1151  YRTPVLSAEASTGETPNLGEVVVAEVGWDALKLNWTAPEGAYEYFFIQVQ  1200
      ||||||||||||||||||||||||||||||||||||||||||||||||||
1151  YRTPVLSAEASTGETPNLGEVVVAEVGWDALKLNWTAPEGAYEYFFIQVQ  1200

1201  EADTVEAAQNLTVPGGLRSTDLPGLKAATHYTITIRGVTQDFSTTPLSVE  1250
      ||||||||||||||||||||||||||||||||||||||||||||||||||
1201  EADTVEAAQNLTVPGGLRSTDLPGLKAATHYTITIRGVTQDFSTTPLSVE  1250

1251  VLTEEVPDMGNLTVTEVSWDALRLNWTTPDGTYDQFTIQVQEADQVEEAH  1300
      ||||||||||||||||||||||||||||||||||||||||||||||||||
1251  VLTEEVPDMGNLTVTEVSWDALRLNWTTPDGTYDQFTIQVQEADQVEEAH  1300

1301  NLTVPGSLRSMEIPGLRAGTPYTVTLHGEVRGHSTRPLAVEVVTEDLPQL  1350
      ||||||||||||||||||||||||||||||||||||||||||||||||||
1301  NLTVPGSLRSMEIPGLRAGTPYTVTLHGEVRGHSTRPLAVEVVTEDLPQL  1350

1351  GDLAVSEVGWDGLRLNWTAADNAYEHFVIQVQEVNKVEAAQNLTLPGSLR  1400
      ||||||||||||||||||||||||||||||||||||||||||||||||||
1351  GDLAVSEVGWDGLRLNWTAADNAYEHFVIQVQEVNKVEAAQNLTLPGSLR  1400

1401  AVDIPGLEAATPYRVSIYGVIRGYRTPVLSAEASTAKEPEIGNLNVSDIT  1450
      ||||||||||||||||||||||||||||||||||||||||||||||||||
1401  AVDIPGLEAATPYRVSIYGVIRGYRTPVLSAEASTAKEPEIGNLNVSDIT  1450

1451  PESFNLSWMATDGIFETFTIEIIDSNRLLETVEYNISGAERTAHISGLPP  1500
      ||||||||||||||||||||||||||||||||||||||||||||||||||
1451  PESFNLSWMATDGIFETFTIEIIDSNRLLETVEYNISGAERTAHISGLPP  1500

1501  STDFIVYLSGLAPSIRTKTISATAT.........................  1525
      ||||||||||||||||||||||||
1501  STDFIVYLSGLAPSIRTKTISATATTEALPLLENLTISDINPYGFTVSWM  1550

1525  ..................................................  1525

1551  ASENAFDSFLVTVVDSGKLLDPQEFTLSGTQRKLELRGLITGIGYEVMVS  1600

1526  ...............TEAEPEVDNLLVSDATPDGFRLSWTADEGVFDNF  1559
                     |||||||||||||||||||||||||||||||||||
1601  GFTQGHQTKPLRAEIVTEAEPEVDNLLVSDATPDGFRLSWTADEGVFDNF  1650

1560  VLKIRDTKKQSEPLEITLLAPERTRDLTGLREATEYEIELYGISKGRRSQ  1609
      ||||||||||||||||||||||||||||||||||||||||||||||||||
1651  VLKIRDTKKQSEPLEITLLAPERTRDLTGLREATEYEIELYGISKGRRSQ  1700

1610  TVSAIATTAMGSPKEVIFSDITENSATVSWRAPTAQVESFRITYVPITGG  1659
      ||||||||||||||||||||||||||||||||||||||||||||||||||
1701  TVSAIATTAMGSPKEVIFSDITENSATVSWRAPTAQVESFRITYVPITGG  1750

1660  TPSMVTVDGTKTQTRLVKLIPGVEYLVSIIAMKGFEESEPVSGSFTTALD  1709
      ||||||||||||||||||||||||||||||||||||||||||||||||||
1751  TPSMVTVDGTKTQTRLVKLIPGVEYLVSIIAMKGFEESEPVSGSFTTALD  1800

1710  GPSGLVTANITDSEALARWQPAIATVDSYVISYTGEKVPEITRRVSGNTV  1759
      ||||||||||||||||||||||||||||||||||||||||||||||||||
1801  GPSGLVTANITDSEALARWQPAIATVDSYVISYTGEKVPEITRTVSGNTV  1850

1760  EYALTDLEPATEYTLRIFAEKGPQKSSTITAKFTTDLDSPRDLTATEVQS  1809
      ||||||||||||||||||||||||||||||||||||||||||||||||||
1851  EYALTDLEPATEYTLRIFAEKGPQKSSTITAKFTTDLDSPRDLTATEVQS  1900

1810  ETALLTWRPPRASVTGYLLVYESVDGTVKEVIVGPDTTSYSLADLSPSTH  1859
      ||||||||||||||||||||||||||||||||||||||||||||||||||
1901  ETALLTWRPPRASVTGYLLVYESVDGTVKEVIVGPDTTSYSLADLSPSTH  1950

1860  YTAKIQALNGPLRSNMIQTIFTTIGLLYPFPKDCSQAMLNGDTTSGLYTI  1909
      ||||||||||||||||||||||||||||||||||||||||||||||||||
1951  YTAKIQALNGPLRSNMIQTIFTTIGLLYPFPKDCSQAMLNGDTTSGLYTI  2000

1910  YLNGDKAQALEVFCDMTSDGGGWIVFLRRKNGRENFYQNWKAYAAGFGDR  1959
      ||||||||||||||||||||||||||||||||||||||||||||||||||
2001  YLNGDKAQALEVFCDMTSDGGGWIVFLRRKNGRENFYQNWKAYAAGFGDR  2050

1960  REEFWLGLDNLNKITAQGQYELRVDLRDHGETAFAVYDKFSVGDAKTRYK  2009
      ||||||||||||||||||||||||||||||||||||||||||||||||||
2051  REEFWLGLDNLNKITAQGQYELRVDLRDHGETAFAVYDKFSVGDAKTRYK  2100
```

-continued

```
2010 LKVEGYSGTAGDSMAYHNGRSFSTFDKDTDSAITNCALSYKGAFWYRNCH 2059
     ||||||||||||||||||||||||||||||||||||||||||||||||||
2101 LKVEGYSGTAGDSMAYHNGRSFSTFDKDTDSAITNCALSYKGAFWYRNCH 2150

2060 RVNLMGRYGDNNHSQGVNWFHWKGHEHSIQFAEMKLRPSNFRNLEGRRKR 2109
     |||||||||||||||||||||||||||||||||||||||||||||||||
2151 RVNLMGRYGDNNHSQGVNWFHWKGHEHSIQFAEMKLRPSNFRNLEGRRKR 2200

2100 A                                                  2110
     |
2201 A                                                  2201
```

Sequence name: TENA_HUMAN_V1

Sequence documentation:

Alignment of: HUMTEN_PEA__1_P10 (SEQ ID NO: 938) x TENA_HUMAN_V1 . . .

Alignment segment 1/1:
 Quality: 20725.00

Escore: 0
 Matching length: 2110 Total length: 2201

Matching Percent Similarity: 100.00 Matching Percent Identity: 100.00

Total Percent Similarity: 95.87 Total Percent Identity: 95.87

Gaps: 1

Alignment:

```
  1 MGAMTQLLAGVFLAFLALATEGGVLKKVIRHKRQSGVNATLPEENQPVVF  50
    |||||||||||||||||||||||||||||||||||||||||||||||||
  1 MGAMTQLLAGVFLAFLALATEGGVLKKVIRHKRQSGVNATLPEENQPVVF  50

51 NHVYNIKLPVGSQCSVDLESASGEKDLAPPSEPSESFQEHTVDGENQIVF 100
    |||||||||||||||||||||||||||||||||||||||||||||||||
 51 NHVYNIKLPVGSQCSVDLESASGEKDLAPPSEPSESFQEHTVDGENQIVF 100

101 THRINIPRRACGCAAAPDVKELLSRLEELENLVSSLREQCTAGAGCCLQP 150
    |||||||||||||||||||||||||||||||||||||||||||||||||
101 THRINIPRRACGCAAAPDVKELLSRLEELENLVSSLREQCTAGAGCCLQP 150

151 ATGRLDTRPFCSGRGNFSTEGCGCVCEPGWKGPNCSEPECPGNCHLRGRC 200
    |||||||||||||||||||||||||||||||||||||||||||||||||
151 ATGRLDTRPFCSGRGNFSTEGCGCVCEPGWKGPNCSEPECPGNCHLRGRC 200

201 IDGQCICDDGFTGEDCSQLACPSDCNDQGKCVNGVCICFEGYAGADCSRE 250
    |||||||||||||||||||||||||||||||||||||||||||||||||
201 IDGQCICDDGFTGEDCSQLACPSDCNDQGKCVNGVCICFEGYAGADCSRE 250

251 ICPVPCSEEHGTCVDGLCVCHDGFAGDDCNKPLCLNNCYNRGRCVENECV 300
    |||||||||||||||||||||||||||||||||||||||||||||||||
251 ICPVPCSEEHGTCVDGLCVCHDGFAGDDCNKPLCLNNCYNRGRCVENECV 300

301 CDEGFTGEDCSELICPNDCFDRGRCINGTCYCEEGFTGEDCGKPTCPHAC 350
    |||||||||||||||||||||||||||||||||||||||||||||||||
301 CDEGFTGEDCSELICPNDCFDRGRCINGTCYCEEGFTGEDCGKPTCPHAC 350

351 HTQGRCEEGQCVCDEGFAGVDCSEKRCPADCKNRGRCVDGRCECDDGFTG 400
    ||||||||||||||||||||||||||||||||| |||||||||||||||
351 HTQGRCEEGQCVCDEGFAGVDCSEKRCPADCHNRGRCVDGRCECDDGFTG 400

401 ADCGELKCPNGCSGHGRCVNGQCVCDEGYTGEDCSQLRCPNDCHSRGRCV 450
    |||||||||||||||||||||||||||||||||||||||||||||||||
401 ADCGELKCPNGCSGHGRCVNGQCVCDEGYTGEDCSQLRCPNDCHSRGRCV 450

451 EGKCVCEQGFKGYDCSDMSCPNDCHQHGRCVNGMCVCDDGYTGEDCRDRQ 500
    |||||||||||||||||||||||||||||||||||||||||||||||||
451 EGKCVCEQGFKGYDCSDMSCPNDCHQHGRCVNGMCVCDDGYTGEDCRDRQ 500

501 CPRDCSNRGLCVDGQCVCEDGFTGPDCAELSCPNDCHGRGRCVNGQCVCH 550
    |||||||||||||||||||||||||||||||||||||||||||||||||
501 CPRDCSNRGLCVDGQCVCEDGFTGPDCAELSCPNDCHGRGRCVNGQCVCH 550

551 EGFMGKDCKEQRCPSDCHGQGRCVDGQCICHEGFTGLDCGQHSCPSDCNN 600
    ||| |||||||||||||||||||||||||||||||||||||||||||||
551 EGFMCKDCKEQRCPSDCHGQGRCVDGQCICHEGFTGLDCGQHSCPSDCNN 600
```

```
-continued

601  LGQCVSGRCICNEGYSGEDCSEVSPPKDLVVTEVTEETVNLAWDNEMRVT   650
      ||||||||||||||||||||||||||||||||||||||||||||||||||
 601  LGQCVSGRCICNEGYSGEDCSEVSPPKDLVVTEVTEETVNLAWDNEMRVT   650

651  EYLVVYTPTHEGGLEMQFRVPGDQTSTIIQELEPGVEYFIRVFAILENKK   700
      |||||||||||||||||||||||||||||||||||||||||||||||||
 651  EYLVVYTPTHEGGLEMQFRVPGDQTSTIIQELEPGVEYFIRVFAILENKK   700

701  SIPVSARVATYLPAPEGLKFKSIKETSVEVEWDPLDIAFETWEIIFRNMN   750
      |||||||||||||||||||||||||||||||||||||||||||||||||
 701  SIPVSARVATYLPAPEGLKFKSIKETSVEVEWDPLDIAFETWEIIFRNMN   750

751  KEDEGEITKSLRRPETSYRQTGLAPGQEYEISLHIVKNNTRGPGLKRVTT   800
      |||||||||||||||||||||||||||||||||||||||||||||||||
 751  KEDEGEITKSLRRPETSYRQTGLAPGQEYEISLHIVKNNTRGPGLKRVTT   800

801  TRLDAPSQIEVKDVTDTTALITWFKPLAEIDGIELTYGIKDVPGDRTTID   850
      |||||||||||||||||||||||||||||||||||||||||||||||||
 801  TRLDAPSQIEVKDVTDTTALITWFKPLAEIDGIELTYGIKDVPGDRTTID   850

851  LTEDENQYSIGNLKPDTEYEVSLISRRGDMSSNPAKETFTTGLDAPRNLR   900
      |||||||||||||||||||||||||||||||||||||||||||||||||
 851  LTEDENQYSIGNLKPDTEYEVSLISRRGDMSSNPAKETFTTGLDAPRNLR   900

901  RVSQTDNSITLEWRNGKAAIDSYRIKYAPISGGDHAEVDVPKSQQATTKT   950
      |||||||||||||||||||||||||||||||||||||||||||||||||
 901  RVSQTDNSITLEWRNGKAAIDSYRIKYAPISGGDHAEVDVPKSQQATTKT   950

951  TLTGLRPGTEYGIGVSAVKEDKESNPATINAATELDTPKDLQVSETAETS  1000
      ||||||||||||||||||||||||||||||||||||||||||||||||||
 951  TLTGLRPGTEYGIGVSAVKEDKESNPATINAATELDTPKDLQVSETAETS  1000

1001  LTLLWKTPLAKFDRYRLNYSLPTGQWVGVQLPRNTTSYVLRGLEPGQEYN  1050
      |||||||||||||||||||||||||||||||||||||||||||||||||
1001  LTLLWKTPLAKFDRYRLNYSLPTGQWVGVQLPRNTTSYVLRGLEPGQEYN  1050

1051  VLLTAEKGRHKSKPARVKASTEQAPELENLTVTEVGWDGLRLNWTAADQA  1100
      |||||||||||||||||||||||| |||||||||||||||||||||||||
1051  VLLTAEKGRHKSKPARVKASTEQARELENLTVTEVGWDGLRLNWTAADQA  1100

1101  YEHFIIQVQEANKVEAARNLTVPGSLRAVDIPGLKAATPYTVSIYGVIQG  1150
      |||||||||||||||||||||||||||||||||||||||||||||||||
1101  YEHFIIQVQEANKVEAARNLTVPGSLRAVDIPGLKAATPYTVSIYGVIQG  1150

1151  YRTPVLSAEASTGETPNLGEVVVAEVGWDALKLNWTAPEGAYEYFFIQVQ  1200
      |||||||||||||||||||||||||||||||||||||||||||||||||
1151  YRTPVLSAEASTGETPNLGEVVVAEVGWDALKLNWTAPEGAYEYFFIQVQ  1200

1201  EADTVEAAQNLTVPGGLRSTDLPGLKAATHYTITIRGVTQDFSTTPLSVE  1250
      |||||||||||||||||||||||||||||||||||||||||||||||||
1201  EADTVEAAQNLTVPGGLRSTDLPGLKAATHYTITIRGVTQDFSTTPLSVE  1250

1251  VL................................................  1252
      ||
1251  VLTEEVPDMGNLTVTEVSWDALRLNWTTPDGTYDQFTIQVQEADQVEEAH  1300

1253  ...........................................TEDLPQL  1259
                                                 |||||||
1301  NLTVPGSLRSMEIPGLRAGTPYTVTLHGEVRGHSTRPLAVEVVTEDLPQL  1350

1260  GDLAVSEVGWDGLRLNWTAADNAYEHFVIQVQEVNKVEAAQNLTLPGSLR  1309
      |||||||||||||||||||||||||||||||||||||||||||||||||
1351  GDLAVSEVGWDGLRLNWTAADNAYEHFVIQVQEVNKVEAAQNLTLPGSLR  1400

1310  AVDIPGLEAATPYRVSIYGVIRGYRTPVLSAEASTAKEPEIGNLNVSDIT  1359
      |||||||||||||||||||||||||||||||||||||||||||||||||
1401  AVDIPGLEAATPYRVSIYGVIRGYRTPVLSAEASTAKEPEIGNLNVSDIT  1450

1360  PESFNLSWMATDGIFETFTIEIIDSNRLLETVEYNISGAERTAHISGLPP  1409
      |||||||||||||||||||||||||||||||||||||||||||||||||
1451  PESFNLSWMATDGIFETFTIEIIDSNRLLETVEYNISGAERTAHISGLPP  1500

1410  STDFIVYLSGLAPSIRTKTISATATTEALPLLENLTISDINPYGFTVSWM  1459
      |||||||||||||||||||||||||||||||||||||||||||||||||
1501  STDFIVYLSGLAPSIRTKTISATATTEALPLLENLTISDINPYGFTVSWM  1550

1460  ASENAFDSFLVTVVDSGKLLDPQEFTLSGTQRKLELRGLITGIGYEVMVS  1509
      |||||||||||||||||||||||||||||||||||||||||||||||||
1551  ASENAFDSFLVTVVDSGKLLDPQEFTLSGTQRKLELRGLITGIGYEVMVS  1600
```

```
1510  GFTQGHQTKPLRAEIVTEAEPEVDNLLVSDATPDGFRLSWTADEGVFDNF  1559
      ||||||||||||||||||||||||||||||||||||||||||||||||||
1601  GFTQGHQTKPLRAEIVTEAEPEVDNLLVSDATPDGFRLSWTADEGVFDNF  1650

1560  VLKIRDTKKQSEPLEITLLAPERTRDLTGLREATEYEIELYGISKGRRSQ  1609
      ||||||||||||||||||||||||||||||||||||||||||||||||||
1651  VLKIRDTKKQSEPLEITLLAPERTRDLTGLREATEYEIELYGISKGRRSQ  1700

1610  TVSAIATTAMGSPKEVIFSDITENSATVSWRAPTAQVESFRITYVPITGG  1659
      ||||||||||||||||||||||||||||||||||||||||||||||||||
1701  TVSAIATTAMGSPKEVIFSDITENSATVSWRAPTAQVESFRITYVPITGG  1750

1660  TPSMVTVDGTKTQTRLVKLIPGVEYLVSIIAMKGFEESEPVSGSFTTALD  1709
      ||||||||||||||||||||||||||||||||||||||||||||||||||
1751  TPSMVTVDGTKTQTRLVKLIPGVEYLVSIIAMKGFEESEPVSGSFTTALD  1800

1710  GPSGLVTANITDSEALARWQPAIATVDSYVISYTGEKVPEITRRVSGNTV  1759
      ||||||||||||||||||||||||||||||||||||||||||||||||||
1801  GPSGLVTANITDSEALARWQPAIATVDSYVISYTGEKVPEITRTVSGNTV  1850

1760  EYALTDLEPATEYTLRIFAEKGPQKSSTITAKFTTDLDSPRDLTATEVQS  1809
      ||||||||||||||||||||||||||||||||||||||||||||||||||
1851  EYALTDLEPATEYTLRIFAEKGPQKSSTITAKFTTDLDSPRDLTATEVQS  1900

1810  ETALLTWRPPRASVTGYLLVYESVDGTVKEVIVGPDTTSYSLADLSPSTH  1859
      ||||||||||||||||||||||||||||||||||||||||||||||||||
1901  ETALLTWRPPRASVTGYLLVYESVDGTVKEVIVGPDTTSYSLADLSPSTH  1950

1860  YTAKIQALNGPLRSNMIQTIFTTIGLLYPFPKDCSQAMLNGDTTSGLYTI  1909
      ||||||||||||||||||||||||||||||||||||||||||||||||||
1951  YTAKIQALNGPLRSNMIQTIFTTIGLLYPFPKDCSQAMLNGDTTSGLYTI  2000

1910  YLNGDKAQALEVFCDMTSDGGGWIVFLRRKNGRENFYQNWKAYAAGFGDR  1959
      ||||||||||||||||||||||||||||||||||||||||||||||||||
2001  YLNGDKAQALEVFCDMTSDGGGWIVFLRRKNGRENFYQNWKAYAAGFGDR  2050

1960  REEFWLGLDNLNKITAQGQYELRVDLRDHGETAFAVYDKFSVGDAKTRYK  2009
      ||||||||||||||||||||||||||||||||||||||||||||||||||
2051  REEFWLGLDNLNKITAQGQYELRVDLRDHGETAFAVYDKFSVGDAKTRYK  2100

2010  LKVEGYSGTAGDSMAYHNGRSFSTFDKDTDSAITNCALSYKGAFWYRNCH  2059
      ||||||||||||||||||||||||||||||||||||||||||||||||||
2101  LKVEGYSGTAGDSMAYHNGRSFSTFDKDTDSAITNCALSYKGAFWYRNCH  2150

2060  RVNLMGRYGDNNHSQGVNWFHWKGHEHSIQFAEMKLRPSNFRNLEGRRKR  2109
      ||||||||||||||||||||||||||||||||||||||||||||||||||
2151  RVNLMGRYGDNNHSQGVNWFHWKGHEHSIQFAEMKLRPSNFRNLEGRRKR  2200

2110  A                                                 2110
      |
2201  A                                                 2201
```

Sequence name: TENA_HUMAN_V1

Sequence documentation:

Alignment of: HUMTEN_PEA_1_P11 (SEQ ID NO: 939) x TENA_HUMAN_V1 . . .

Alignment segment 1/1:
  Quality: 18990.00

Escore: 0
  Matching length: 1928 Total length: 2201

Matching Percent Similarity: 100.00 Matching Percent Identity: 100.00

Total Percent Similarity: 87.60 Total Percent Identity: 87.60

Gaps: 1

Alignment:

```
  1  MGAMTQLLAGVFLAFLALATEGGVLKKVIRHKRQSGVNATLPEENQPVVF   50
     ||||||||||||||||||||||||||||||||||||||||||||||||||
  1  MGAMTQLLAGVFLAFLALATEGGVLKKVIRHKRQSGVNATLPEENQPVVF   50

51  NHVYNIKLPVGSQCSVDLESASGEKDLAPPSEPSESFQEHTVDGENQIVF  100
     ||||||||||||||||||||||||||||||||||||||||||||||||||
 51  NHVYNIKLPVGSQCSVDLESASGEKDLAPPSEPSESFQEHTVDGENQIVF  100
```

```
101  THRINIPRRACGCAAAPDVKELLSRLEELENLVSSLREQCTAGAGCCLQP  150
     ||||||||||||||||||||||||||||||||||||||||||||||||||
101  THRINIPRRACGCAAAPDVKELLSRLEELENLVSSLREQCTAGAGCCLQP  150

151  ATGRLDTRPFCSGRGNFSTEGCGCVCEPGWKGPNCSEPECPGNCHLRGRC  200
     ||||||||||||||||||||||||||||||||||||||||||||||||||
151  ATGRLDTRPFCSGRGNFSTEGCGCVCEPGWKGPNCSEPECPGNCHLRGRC  200

201  IDGQCICDDGFTGEDCSQLACPSDCNDQGKCVNGVCICFEGYAGADCSRE  250
     ||||||||||||||||||||||||||||||||||||||||||||||||||
201  IDGQCICDDGFTGEDCSQLACPSDCNDQGKCVNGVCICFEGYAGADCSRE  250

251  ICPVPCSEEHGTCVDGLCVCHDGFAGDDCNKPLCLNNCYNRGRCVENECV  300
     ||||||||||||||||||||||||||||||||||||||||||||||||||
251  ICPVPCSEEHGTCVDGLCVCHDGFAGDDCNKPLCLNNCYNRGRCVENECV  300

301  CDEGFTGEDCSELICPNDCFDRGRCINGTCYCEEGFTGEDCGKPTCPHAC  350
     ||||||||||||||||||||||||||||||||||||||||||||||||||
301  CDEGFTGEDCSELICPNDCFDRGRCINGTCYCEEGFTGEDCGKPTCPHAC  350

351  HTQGRCEEGQCVCDEGFAGVDCSEKRCPADCKNRGRCVDGRCECDDGFTG  400
     ||||||||||||||||||||||||||||||||||||||||||||||||||
351  HTQGRCEEGQCVCDEGFAGVDCSEKRCPADCHNRGRCVDGRCECDDGFTG  400

401  ADCGELKCPNGCSGHGRCVNGQCVCDEGYTGEDCSQLRCPNDCHSRGRCV  450
     ||||||||||||||||||||||||||||||||||||||||||||||||||
401  ADCGELKCPNGCSGHGRCVNGQCVCDEGYTGEDCSQLRCPNDCHSRGRCV  450

451  EGKCVCEQGFKGYDCSDMSCPNDCHQHGRCVNGMCVCDDGYTGEDCRDRQ  500
     ||||||||||||||||||||||||||||||||||||||||||||||||||
451  EGKCVCEQGFKGYDCSDMSCPNDCHQHGRCVNGMCVCDDGYTGEDCRDRQ  500

501  CPRDCSNRGLCVDGQCVCEDGFTGPDCAELSCPNDCHGRGRCVNGQCVCH  550
     ||||||||||||||||||||||||||||||||||||||||||||||||||
501  CPRDCSNRGLCVDGQCVCEDGFTGPDCAELSCPNDCHGRGRCVNGQCVCH  550

551  EGFMGKDCKEQRCPSDCHGQGRCVDGQCICHEGFTGLDCGQHSCPSDCNN  600
     ||||||||||||||||||||||||||||||||||||||||||||||||||
551  EGFMCKDCKEQRCPSDCHGQGRCVDGQCICHEGFTGLDCGQHSCPSDCNN  600

601  LGQCVSGRCICNEGYSGEDCSEVSPPKDLVVTEVTEETVNLAWDNEMRVT  650
     ||||||||||||||||||||||||||||||||||||||||||||||||||
601  LGQCVSGRCICNEGYSGEDCSEVSPPKDLVVTEVTEETVNLAWDNEMRVT  650

651  EYLVVYTPTHEGGLEMQFRVPGDQTSTIIQELEPGVEYFIRVFAILENKK  700
     ||||||||||||||||||||||||||||||||||||||||||||||||||
651  EYLVVYTPTHEGGLEMQFRVPGDQTSTIIQELEPGVEYFIRVFAILENKK  700

701  SIPVSARVATYLPAPEGLKFKSIKETSVEVEWDPLDIAFETWEIIFRNMN  750
     ||||||||||||||||||||||||||||||||||||||||||||||||||
701  SIPVSARVATYLPAPEGLKFKSIKETSVEVEWDPLDIAFETWEIIFRNMN  750

751  KEDEGEITKSLRRPETSYRQTGLAPGQEYEISLHIVKNNTRGPGLKRVTT  800
     ||||||||||||||||||||||||||||||||||||||||||||||||||
751  KEDEGEITKSLRRPETSYRQTGLAPGQEYEISLHIVKNNTRGPGLKRVTT  800

801  TRLDAPSQIEVKDVTDTTALITWFKPLAEIDGIELTYGIKDVPGDRTTID  850
     ||||||||||||||||||||||||||||||||||||||||||||||||||
801  TRLDAPSQIEVKDVTDTTALITWFKPLAEIDGIELTYGIKDVPGDRTTID  850

851  LTEDENQYSIGNLKPDTEYEVSLISRRGDMSSNPAKETFTTGLDAPRNLR  900
     ||||||||||||||||||||||||||||||||||||||||||||||||||
851  LTEDENQYSIGNLKPDTEYEVSLISRRGDMSSNPAKETFTTGLDAPRNLR  900

901  RVSQTDNSITLEWRNGKAAIDSYRIKYAPISGGDHAEVDVPKSQQATTKT  950
     ||||||||||||||||||||||||||||||||||||||||||||||||||
901  RVSQTDNSITLEWRNGKAAIDSYRIKYAPISGGDHAEVDVPKSQQATTKT  950

951  TLTGLRPGTEYGIGVSAVKEDKESNPATINAATELDTPKDLQVSETAETS  1000
     ||||||||||||||||||||||||||||||||||||||||||||||||||
951  TLTGLRPGTEYGIGVSAVKEDKESNPATINAATELDTPKDLQVSETAETS  1000

1001 LTLLWKTPLAKFDRYRLNYSLPTGQWVGVQLPRNTTSYVLRGLEPGQEYN  1050
     ||||||||||||||||||||||||||||||||||||||||||||||||||
1001 LTLLWKTPLAKFDRYRLNYSLPTGQWVGVQLPRNTTSYVLRGLEPGQEYN  1050

1051 VLLTAEKGRHKSKPARVKASTEQAPELENLTVTEVGWDGLRLNWTAADQA  1100
     ||||||||||||||||||||||||||||||||||||||||||||||||||
1051 VLLTAEKGRHKSKPARVKASTEQARELENLTVTEVGWDGLRLNWTAADQA  1100
```

-continued

```
1101 YEHFIIQVQEANKVEAARNLTVPGSLRAVDIPGLKAATPYTVSIYGVIQ.  1149
     |||||||||||||||||||||||||||||||||||||||||||||||||
1101 YEHFIIQVQEANKVEAARNLTVPGSLRAVDIPGLKAATPYTVSIYGVIQG  1150

1149 .................................................  1149

1151 YRTPVLSAEASTGETPNLGEVVVAEVGWDALKLNWTAPEGAYEYFFIQVQ  1200

1149 .................................................  1149

1201 EADTVEAAQNLTVPGGLRSTDLPGLKAATHYTITIRGVTQDFSTTPLSVE  1250

1149 .................................................  1149

1251 VLTEEVPDMGNLTVTEVSWDALRLNWTTPDGTYDQFTIQVQEADQVEEAH  1300

1149 .................................................  1149

1301 NLTVPGSLRSMEIPGLRAGTPYTVTLHGEVRGHSTRPLAVEVVTEDLPQL  1350

1149 .................................................  1149

1351 GDLAVSEVGWDGLRLNWTAADNAYEHFVIQVQEVNKVEAAQNLTLPGSLR  1400

1150 .....................GYRTPVLSAEASTAKEPEIGNLNVSDIT  1177
                          |||||||||||||||||||||||||||||
1401 AVDIPGLEAATPYRVSIYGVIRGYRTPVLSAEASTAKEPEIGNLNVSDIT  1450

1178 PESFNLSWMATDGIFETFTIEIIDSNRLLETVEYNISGAERTAHISGLPP  1227
     |||||||||||||||||||||||||||||||||||||||||||||||||
1451 PESFNLSWMATDGIFETFTIEIIDSNRLLETVEYNISGAERTAHISGLPP  1500

1228 STDFIVYLSGLAPSIRTKTISATATTEALPLLENLTISDINPYGFTVSWN  1277
     |||||||||||||||||||||||||||||||||||||||||||||||||
1501 STDFIVYLSGLAPSIRTKTISATATTEALPLLENLTISDINPYGFTVSWN  1550

1278 ASENAFDSFLVTVVDSGKLLDPQEFTLSGTQRKLELRGLITGIGYEVMVS  1327
     |||||||||||||||||||||||||||||||||||||||||||||||||
1551 ASENAFDSFLVTVVDSGKLLDPQEFTLSGTQRKLELRGLITGIGYEVMVS  1600

1328 GFTQGHQTKPLRAEIVTEAEPEVDNLLVSDATPDGFRLSWTADEGVFDNF  1377
     |||||||||||||||||||||||||||||||||||||||||||||||||
1601 GFTQGHQTKPLRAEIVTEAEPEVDNLLVSDATPDGFRLSWTADEGVFDNF  1650

1378 VLKIRDTKKQSEPLEITLLAPERTRDLTGLREATEYEIELYGISKGRRSQ  1427
     |||||||||||||||||||||||||||||||||||||||||||||||||
1651 VLKIRDTKKQSEPLEITLLAPERTRDLTGLREATEYEIELYGISKGRRSQ  1700

1428 TVSAIATTAMGSPKEVIFSDITENSATVSWRAPTAQVESFRITYVPITGG  1477
     |||||||||||||||||||||||||||||||||||||||||||||||||
1701 TVSAIATTAMGSPKEVIFSDITENSATVSWRAPTAQVESFRITYVPITGG  1750

1478 TPSMVTVDGTKTQTRLVKLIPGVEYLVSIIAMKGFEESEPVSGSFTTALD  1527
     |||||||||||||||||||||||||||||||||||||||||||||||||
1751 TPSMVTVDGTKTQTRLVKLIPGVEYLVSIIAMKGFEESEPVSGSFTTALD  1800

1528 GPSGLVTANITDSEALARWQPAIATVDSYVISYTGEKVPEITRRVSGNTV  1577
     |||||||||||||||||||||||||||||||||||||||||||||||||
1801 GPSGLVTANITDSEALARWQPAIATVDSYVISYTGEKVPEITRTVSGNTV  1850

1578 EYALTDLEPATEYTLRIFAEKGPQKSSTITAKFTTDLDSPRDLTATEVQS  1627
     |||||||||||||||||||||||||||||||||||||||||||||||||
1851 EYALTDLEPATEYTLRIFAEKGPQKSSTITAKFTTDLDSPRDLTATEVQS  1900

1628 ETALLTWRPPRASVTGYLLVYESVDGTVKEVIVGPDTTSYSLADLSPSTH  1677
     |||||||||||||||||||||||||||||||||||||||||||||||||
1901 ETALLTWRPPRASVTGYLLVYESVDGTVKEVIVGPDTTSYSLADLSPSTH  1950

1678 YTAKIQALNGPLRSNMIQTIFTTIGLLYPFPKDCSQAMLNGDTTSGLYTI  1727
     |||||||||||||||||||||||||||||||||||||||||||||||||
1951 YTAKIQALNGPLRSNMIQTIFTTIGLLYPFPKDCSQAMLNGDTTSGLYTI  2000

1728 YLNGDKAQALEVFCDMTSDGGGWIVFLRRKNGRENFYQNWKAYAAGFGDR  1777
     |||||||||||||||||||||||||||||||||||||||||||||||||
2001 YLNGDKAQALEVFCDMTSDGGGWIVFLRRKNGRENFYQNWKAYAAGFGDR  2050

1778 REEFWLGLDNLNKITAQGQYELRVDLRDHGETAFAVYDKFSVGDAKTRYK  1827
     |||||||||||||||||||||||||||||||||||||||||||||||||
2051 REEFWLGLDNLNKITAQGQYELRVDLRDHGETAFAVYDKFSVGDAKTRYK  2100
```

-continued

```
1828  LKVEGYSGTAGDSMAYHNGRSFSTFDKDTDSAITNCALSYKGAFWYRNCH  1877
      ||||||||||||||||||||||||||||||||||||||||||||||||||
2101  LKVEGYSGTAGDSMAYHNGRSFSTFDKDTDSAITNCALSYKGAFWYRNCH  2150

1878  RVNLMGRYGDNNHSQGVNWFHWKGHEHSIQFAEMKLRPSNFRNLEGRRKR  1927
      ||||||||||||||||||||||||||||||||||||||||||||||||||
2151  RVNLMGRYGDNNHSQGVNWFHWKGHEHSIQFAEMKLRPSNFRNLEGRRKR  2200

1928  A                                                   1928
      |
2201  A                                                   2201
```

Sequence name: TENA_HUMAN_V1

Sequence documentation:

Alignment of: HUMTEN_PEA_1_P13 (SEQ ID NO: 940) x TENA_HUMAN_V1 . . .

Alignment segment 1/1:
  Quality: 18153.00
Escore: 0
  Matching length: 1837 Total length: 2201

Matching Percent Similarity: 100.00 Matching Percent Identity: 100.00

Total Percent Similarity: 83.46 Total Percent Identity: 83.46
  Gaps: 1

Alignment:

```
  1  MGAMTQLLAGVFLAFLALATEGGVLKKVIRHKRQSGVNATLPEENQPVVF   50
     ||||||||||||||||||||||||||||||||||||||||||||||||||
  1  MGAMTQLLAGVFLAFLALATEGGVLKKVIRHKRQSGVNATLPEENQPVVF   50

51  NHVYNIKLPVGSQCSVDLESASGEKDLAPPSEPSESFQEHTVDGENQIVF  100
     ||||||||||||||||||||||||||||||||||||||||||||||||||
 51  NHVYNIKLPVGSQCSVDLESASGEKDLAPPSEPSESFQEHTVDGENQIVF  100

101  THRINIPRRACGCAAAPDVKELLSRLEELENLVSSLREQCTAGAGCCLQP  150
     ||||||||||||||||||||||||||||||||||||||||||||||||||
101  THRINIPRRACGCAAAPDVKELLSRLEELENLVSSLREQCTAGAGCCLQP  150

151  ATGRLDTRPFCSGRGNFSTEGCGCVCEPGWKGPNCSEPECPGNCHLRGRC  200
     ||||||||||||||||||||||||||||||||||||||||||||||||||
151  ATGRLDTRPFCSGRGNFSTEGCGCVCEPGWKGPNCSEPECPGNCHLRGRC  200

201  IDGQCICDDGFTGEDCSQLACPSDCNDQGKCVNGVCICFEGYAGADCSRE  250
     ||||||||||||||||||||||||||||||||||||||||||||||||||
201  IDGQCICDDGFTGEDCSQLACPSDCNDQGKCVNGVCICFEGYAGADCSRE  250

251  ICPVPCSEEHGTCVDGLCVCHDGFAGDDCNKPLCLNNCYNRGRCVENECV  300
     ||||||||||||||||||||||||||||||||||||||||||||||||||
251  ICPVPCSEEHGTCVDGLCVCHDGFAGDDCNKPLCLNNCYNRGRCVENECV  300

301  CDEGFTGEDCSELICPNDCFDRGRCINGTCYCEEGFTGEDCGKPTCPHAC  350
     ||||||||||||||||||||||||||||||||||||||||||||||||||
301  CDEGFTGEDCSELICPNDCFDRGRCINGTCYCEEGFTGEDCGKPTCPHAC  350

351  HTQGRCEEGQCVCDEGFAGVDCSEKRCPADCKNRGRCVDGRCECDDGFTG  400
     ||||||||||||||||||||||||||||||||||||||||||||||||||
351  HTQGRCEEGQCVCDEGFAGVDCSEKRCPADCHNRGRCVDGRCECDDGFTG  400

401  ADCGELKCPNGCSGHGRCVNGQCVCDEGYTGEDCSQLRCPNDCHSRGRCV  450
     ||||||||||||||||||||||||||||||||||||||||||||||||||
401  ADCGELKCPNGCSGHGRCVNGQCVCDEGYTGEDCSQLRCPNDCHSRGRCV  450

451  EGKCVCEQGFKGYDCSDMSCPNDCHQHGRCVNGMCVCDDGYTGEDCRDRQ  500
     ||||||||||||||||||||||||||||||||||||||||||||||||||
451  EGKCVCEQGFKGYDCSDMSCPNDCHQHGRCVNGMCVCDDGYTGEDCRDRQ  500

501  CPRDCSNRGLCVDGQCVCEDGFTGPDCAELSCPNDCHGRGRCVNGQCVCH  550
     ||||||||||||||||||||||||||||||||||||||||||||||||||
501  CPRDCSNRGLCVDGQCVCEDGFTGPDCAELSCPNDCHGRGRCVNGQCVCH  550

551  EGFMGKDCKEQRCPSDCHGQGRCVDGQCICHEGFTGLDCGQHSCPSDCNN  600
     ||||||||||||||||||||||||||||||||||||||||||||||||||
551  EGFMCKDCKEQRCPSDCHGQGRCVDGQCICHEGFTGLDCGQHSCPSDCNN  600
```

```
601  LGQCVSGRCICNEGYSGEDCSEVSPPKDLVVTEVTEETVNLAWDNEMRVT  650
     ||||||||||||||||||||||||||||||||||||||||||||||||||
601  LGQCVSGRCICNEGYSGEDCSEVSPPKDLVVTEVTEETVNLAWDNEMRVT  650

651  EYLVVYTPTHEGGLEMQFRVPGDQTSTIIQELEPGVEYFIRVFAILENKK  700
     ||||||||||||||||||||||||||||||||||||||||||||||||||
651  EYLVVYTPTHEGGLEMQFRVPGDQTSTIIQELEPGVEYFIRVFAILENKK  700

701  SIPVSARVATYLPAPEGLKFKSIKETSVEVEWDPLDIAFETWEIIFRNMN  750
     ||||||||||||||||||||||||||||||||||||||||||||||||||
701  SIPVSARVATYLPAPEGLKFKSIKETSVEVEWDPLDIAFETWEIIFRNMN  750

751  KEDEGEITKSLRRPETSYRQTGLAPGQEYEISLHIVKNNTRGPGLKRVTT  800
     ||||||||||||||||||||||||||||||||||||||||||||||||||
751  KEDEGEITKSLRRPETSYRQTGLAPGQEYEISLHIVKNNTRGPGLKRVTT  800

801  TRLDAPSQIEVKDVTDTTALITWFKPLAEIDGIELTYGIKDVPGDRTTID  850
     ||||||||||||||||||||||||||||||||||||||||||||||||||
801  TRLDAPSQIEVKDVTDTTALITWFKPLAEIDGIELTYGIKDVPGDRTTID  850

851  LTEDENQYSIGNLKPDTEYEVSLISRRGDMSSNPAKETFTTGLDAPRNLR  900
     ||||||||||||||||||||||||||||||||||||||||||||||||||
851  LTEDENQYSIGNLKPDTEYEVSLISRRGDMSSNPAKETFTTGLDAPRNLR  900

901  RVSQTDNSITLEWRNGKAAIDSYRIKYAPISGGDHAEVDVPKSQQATTKT  950
     ||||||||||||||||||||||||||||||||||||||||||||||||||
901  RVSQTDNSITLEWRNGKAAIDSYRIKYAPISGGDHAEVDVPKSQQATTKT  950

951  TLTGLRPGTEYGIGVSAVKEDKESNPATINAATELDTPKDLQVSETAETS  1000
     ||||||||||||||||||||||||||||||||||||||||||||||||||
951  TLTGLRPGTEYGIGVSAVKEDKESNPATINAATELDTPKDLQVSETAETS  1000

1001 LTLLWKTPLAKFDRYRLNYSLPTGQWVGVQLPRNTTSYVLRGLEPGQEYN  1050
     ||||||||||||||||||||||||||||||||||||||||||||||||||
1001 LTLLWKTPLAKFDRYRLNYSLPTGQWVGVQLPRNTTSYVLRGLEPGQEYN  1050

1051 VLLTAEKGRHKSKPARVKASTEQAPELENLTVTEVGWDGLRLNWTAADQA  1100
     |||||||||||||||||||||||| |||||||||||||||||||||||||
1051 VLLTAEKGRHKSKPARVKASTEQARELENLTVTEVGWDGLRLNWTAADQA  1100

1101 YEHFIIQVQEANKVEAARNLTVPGSLRAVDIPGLKAATPYTVSIYGVIQG  1150
     ||||||||||||||||||||||||||||||||||||||||||||||||||
1101 YEHFIIQVQEANKVEAARNLTVPGSLRAVDIPGLKAATPYTVSIYGVIQG  1150

1151 YRTPVLSAEASTGETPNLGEVVVAEVGWDALKLNWTAPEGAYEYFFIQVQ  1200
     ||||||||||||||||||||||||||||||||||||||||||||||||||
1151 YRTPVLSAEASTGETPNLGEVVVAEVGWDALKLNWTAPEGAYEYFFIQVQ  1200

1201 EADTVEAAQNLTVPGGLRSTDLPGLKAATHYTITIRGVTQDFSTTPLSVE  1250
     ||||||||||||||||||||||||||||||||||||||||||||||||||
1201 EADTVEAAQNLTVPGGLRSTDLPGLKAATHYTITIRGVTQDFSTTPLSVE  1250

1251 VLTEEVPDMGNLTVTEVSWDALRLNWTTPDGTYDQFTIQVQEADQVEEAH  1300
     ||||||||||||||||||||||||||||||||||||||||||||||||||
1251 VLTEEVPDMGNLTVTEVSWDALRLNWTTPDGTYDQFTIQVQEADQVEEAH  1300

1301 NLTVPGSLRSMEIPGLRAGTPYTVTLHGEVRGHSTRPLAVEVV.......  1343
     |||||||||||||||||||||||||||||||||||||||||||
1301 NLTVPGSLRSMEIPGLRAGTPYTVTLHGEVRGHSTRPLAVEVVTEDLPQL  1350

1343 ..................................................  1343

1351 GDLAVSEVGWDGLRLNWTAADNAYEHFVIQVQEVNKVEAAQNLTLPGSLR  1400

1343 ..................................................  1343

1401 AVDIPGLEAATPYRVSIYGVIRGYRTPVLSAEASTAKEPEIGNLNVSDIT  1450

1343 ..................................................  1343

1451 PESFNLSWMATDGIFETFTIEIIDSNRLLETVEYNISGAERTAHISGLPP  1500

1343 ..................................................  1343

1501 STDFIVYLSGLAPSIRTKTISATATTEALPLLENLTISDINPYGFTVSWN  1550

1343 ..................................................  1343

1551 ASENAFDSFLVTVVDSGKLLDPQEFTLSGTQRKLELRGLITGIGYEVMVS  1600
```

-continued

```
1343  ................................................  1343
1601  GFTQGHQTKPLRAEIVTEAEPEVDNLLVSDATPDGFRLSWTADEGVFDNF  1650

1343  ................................................  1343
1651  VLKIRDTKKQSEPLEITLLAPERTRDLTGLREATEYEIELYGISKGRRSQ  1700

1344  .......TAMGSPKEVIFSDITENSATVSWRAPTAQVESFRITYVPITGG  1386
             |||||||||||||||||||||||||||||||||||||||||||
1701  TVSAIATTAMGSPKEVIFSDITENSATVSWRAPTAQVESFRITYVPITGG  1750

1387  TPSMVTVDGTKTQTRLVKLIPGVEYLVSIIAMKGFEESEPVSGSFTTALD  1436
      |||||||||||||||||||||||||||||||||||||||||||||||||
1751  TPSMVTVDGTKTQTRLVKLIPGVEYLVSIIAMKGFEESEPVSGSFTTALD  1800

1437  GPSGLVTANITDSEALARWQPAIATVDSYVISYTGEKVPEITRRVSGNTV  1486
      ||||||||||||||||||||||||||||||||||||||||||| |||||
1801  GPSGLVTANITDSEALARWQPAIATVDSYVISYTGEKVPEITRTVSGNTV  1850

1487  EYALTDLEPATEYTLRIFAEKGPQKSSTITAKFTTDLDSPRDLTATEVQS  1536
      |||||||||||||||||||||||||||||||||||||||||||||||||
1851  EYALTDLEPATEYTLRIFAEKGPQKSSTITAKFTTDLDSPRDLTATEVQS  1900

1537  ETALLTWRPPRASVTGYLLVYESVDGTVKEVIVGPDTTSYSLADLSPSTH  1586
      |||||||||||||||||||||||||||||||||||||||||||||||||
1901  ETALLTWRPPRASVTGYLLVYESVDGTVKEVIVGPDTTSYSLADLSPSTH  1950

1587  YTAKIQALNGPLRSNMIQTIFTTIGLLYPFPKDCSQAMLNGDTTSGLYTI  1636
      |||||||||||||||||||||||||||||||||||||||||||||||||
1951  YTAKIQALNGPLRSNMIQTIFTTIGLLYPFPKDCSQAMLNGDTTSGLYTI  2000

1637  YLNGDKAQALEVFCDMTSDGGGWIVFLRRKNGRENFYQNWKAYAAGFGDR  1686
      |||||||||||||||||||||||||||||||||||||||||||||||||
2001  YLNGDKAQALEVFCDMTSDGGGWIVFLRRKNGRENFYQNWKAYAAGFGDR  2050

1687  REEFWLGLDNLNKITAQGQYELRVDLRDHGETAFAVYDKFSVGDAKTRYK  1736
      |||||||||||||||||||||||||||||||||||||||||||||||||
2051  REEFWLGLDNLNKITAQGQYELRVDLRDHGETAFAVYDKFSVGDAKTRYK  2100

1737  LKVEGYSGTAGDSMAYHNGRSFSTFDKDTDSAITNCALSYKGAFWYRNCH  1786
      |||||||||||||||||||||||||||||||||||||||||||||||||
2101  LKVEGYSGTAGDSMAYHNGRSFSTFDKDTDSAITNCALSYKGAFWYRNCH  2150

1787  RVNLMGRYGDNNHSQGVNWFHWKGHEHSIQFAEMKLRPSNFRNLEGRRKR  1836
      |||||||||||||||||||||||||||||||||||||||||||||||||
2151  RVNLMGRYGDNNHSQGVNWFHWKGHEHSIQFAEMKLRPSNFRNLEGRRKR  2200

1837  A                                                 1837
      |
2201  A                                                 2201
```

Sequence name: TENA_HUMAN_V1

Sequence documentation:

Alignment of: HUMTEN_PEA_1_P14 (SEQ ID NO: 941) x TENA_HUMAN_V1 . . .

Alignment segment 1/1:
  Quality: 19930.00

Escore: 0
  Matching length: 2025 Total length: 2025

Matching Percent Similarity: 100.00 Matching Percent Identity: 100.00

Total Percent Similarity: 100.00 Total Percent Identity: 100.00

Gaps: 0

Alignment:

```
   1  MGAMTQLLAGVFLAFLALATEGGVLKKVIRHKRQSGVNATLPEENQPVVF   50
      |||||||||||||||||||||||||||||||||||||||||||||||||
   1  MGAMTQLLAGVFLAFLALATEGGVLKKVIRHKRQSGVNATLPEENQPVVF   50

51  NHVYNIKLPVGSQCSVDLESASGEKDLAPPSEPSESFQEHTVDGENQIVF  100
      |||||||||||||||||||||||||||||||||||||||||||||||||
  51  NHVYNIKLPVGSQCSVDLESASGEKDLAPPSEPSESFQEHTVDGENQIVF  100
```

-continued

```
101  THRINIPRRACGCAAAPDVKELLSRLEELENLVSSLREQCTAGAGCCLQP  150
     ||||||||||||||||||||||||||||||||||||||||||||||||||
101  THRINIPRRACGCAAAPDVKELLSRLEELENLVSSLREQCTAGAGCCLQP  150

151  ATGRLDTRPFCSGRGNFSTEGCGCVCEPGWKGPNCSEPECPGNCHLRGRC  200
     |||||||||| |||||||||||||||||||||||||||||||||||||||
151  ATGRLDTRPGCSGRGNFSTEGCGCVCEPGWKGPNCSEPECPGNCHLRGRC  200

201  IDGQCICDDGFTGEDCSQLACPSDCNDQGKCVNGVCICFEGYAGADCSRE  250
     ||||||||||||||||||||||||||||||||||||||||||||||||||
201  IDGQCICDDGFTGEDCSQLACPSDCNDQGKCVNGVCICFEGYAGADCSRE  250

251  ICPVPCSEEHGTCVDGLCVCHDGFAGDDCNKPLCLNNCYNRGRCVENECV  300
     ||||||||||||||||||||||||||||||||||||||||||||||||||
251  ICPVPCSEEHGTCVDGLCVCHDGFAGDDCNKPLCLNNCYNRGRCVENECV  300

201  CDEGFTGEDCSELICPNDCFDRGRCINGTCYCEEGFTGEDCGKPTCPHAC  350
     ||||||||||||||||||||||||||||||||||||||||||||||||||
201  CDEGFTGEDCSELICPNDCFDRGRCINGTCYCEEGFTGEDCGKPTCPHAC  350

251  HTQGRCEEGQCVCDEGFAGVDCSEKRCPADCHNRGRCVDGRCECDDCFTG  400
     |||||||||||||||||||||||||||||||||||||||||||||| |||
251  HTQGRCEEGQCVCDEGFAGVDCSEKRCPADCHNRGRCVDGRCECDDGFTG  400

301  CDEGFTGEDCSELICPNDCFDRGRCINGTCYCEEGFTGEDCGKPTCPHAC  350
     ||||||||||||||||||||||||||||||||||||||||||||||||||
301  CDEGFTGEDCSELICPNDCFDRGRCINGTCYCEEGFTGEDCGKPTCPHAC  350

351  HTQGRCEEGQCVCDEGRAGVDCSEKRCPADCHNRGRCVDGRCECDDGFTG  400
     |||||||||||||||| |||||||||||||||||||||||||||||||||
351  HTQGRCEEGQCVCDEGFAGVDCSEKRCPADCHNRGRCVDGRCECDDGFTG  400

401  ADCGELKCPNGCSGHGRCVNGQCVCDEGYTGEDCSQLRCPNDCHSRGRCV  450
     ||||||||||||||||||||||||||||||||||||||||||||||||||
401  ADCGELKCPNGCSGHGRCVNGQCVCDEGYTGEDCSQLRCPNDCHSRGRCV  450

451  EGKCVCEQGFKGYDCSDMSCPNDCHQHGRCVNGMCVCDDGYTGEDCRDRQ  500
     ||||||||||||||||||||||||||||||||||||||||||||||||||
451  EGKCVCEQGFKGYDCSDMSCPNDCHQHGRCVNGMCVCDDGYTGEDCRDRQ  500

501  CPRDCSNRGLCVDGQCVCEDGFTGPDCAELSCPNDCHGRGRCVNGQCVCH  550
     ||||||||||||||||||||||||||||||||||||||||||||||||||
501  CPRDCSNRGLCVDGQCVCEDGFTGPDCAELSCPNDCHGRGRCVNGQCVCH  550

551  EGFMGKDCKEQRCPSDCHGQGRCVDGQCICHEGFTGLDCGQHSCPSDCNN  600
     ||||||||||||||||||||||||||||||||||||||||||||||||||
551  EGFMGKDCKEQRCPSDCHGQGRCVDGQCICHEGFTGLDCGQHSCPSDCNN  600

601  LGQCVSGRCICNEGYSGEDCSEVSPPKDLVVTEVTEETVNLAWDNEMRVT  650
     ||||||||||||||||||||||||||||||||||||||||||||||||||
601  LGQCVSGRCICNEGYSGEDCSEVSPPKDLVVTEVTEETVNLAWDNEMRVT  650

651  EYLVVYTPTHEGGLEMQFRVPGDQTSTIIQELEPGVEYFIRVFAILENKK  700
     ||||||||||||||||||||||||||||||||||||||||||||||||||
651  EYLVVYTPTHEGGLEMQFRVPGDQTSTIIQELEPGVEYFIRVFAILENKK  700

701  SIPVSARVATYLPAPEGLKFKSIKETSVEVEWDPLDIAFETWEIIFRNMN  750
     ||||||||||||||||||||||||||||||||||||||||||||||||||
701  SIPVSARVATYLPAPEGLKFKSIKETSVEVEWDPLDIAFETWEIIFRNMN  750

751  KEDEGEITKSLRRPETSYRQTGLAPGQEYEISLHIVKNNTRGPGLKRVTT  800
     ||||||||||||||||||||||||||||||||||||||||||||||||||
751  KEDEGEITKSLRRPETSYRQTGLAPGQEYEISLHIVKNNTRGPGLKRVTT  800

801  TRLDAPSQIEVKDVTDTTALITWFKPLAEIDGIELTYGIKDVPGDRTTID  850
     ||||||||||||||||||||||||||||||||||||||||||||||||||
801  TRLDAPSQIEVKDVTDTTALITWFKPLAEIDGIELTYGIKDVPGDRTTID  850

851  LTEDENQYSIGNLKPDTEYEVSLISRRGDMSSNPAKETFTTGLDAPRNLR  900
     ||||||||||||||||||||||||||||||||||||||||||||||||||
851  LTEDENQYSIGNLKPDTEYEVSLISRRGDMSSNPAKETFTTGLDAPRNLR  900

901  RVSQTDNSITLEWRNGKAAIDSYRIKYAPISGGDHAEVDVPKSQQATTKT  950
     ||||||||||||||||||||||||||||||||||||||||||||||||||
901  RVSQTDNSITLEWRNGKAAIDSYRIKYAPISGGDHAEVDVPKSQQATTKT  950

951  TLTGLRPGTEYGIGVSAVKEDKESNPATINAATELDTPKDLQVSETAETS  1000
     ||||||||||||||||||||||||||||||||||||||||||||||||||
951  TLTGLRPGTEYGIGVSAVKEDKESNPATINAATELDTPKDLQVSETAETS  1000
```

```
-continued

1001 LTLLWKTPLAKFDRYRLNYSLPTGQWVGVQLPRNTTSYVLRGLEPGQEYN 1050
     ||||||||||||||||||||||||||||||||||||||||||||||||||
1001 LTLLWKTPLAKFDRYRLNYSLPTGQWVGVQLPRNTTSYVLRGLEPGQEYN 1050

1051 VLLTAEKGRHKSKPARVKASTEQAPELENLTVTEVGWDGLRLNWTAADQA 1100
     ||||||||||||||||||||||||||||||||||||||||||||||||||
1051 VLLTAEKGRHKSKPARVKASTEQAPELENLTVTEVGWDGLRLNWTAADQA 1100

1101 YEHFIIQVQEANKVEAARNLTVPGSLRAVDIPGLKAATPYTVSIYGVIQG 1150
     ||||||||||||||||||||||||||||||||||||||||||||||||||
1101 YEHFIIQVQEANKVEAARNLTVPGSLRAVDIPGLKAATPYTVSIYGVIQG 1150

1151 YRTPVLSAEASTGETPNLGEVVVAEVGWDALKLNWTAPEGAYEYFFIQVQ 1200
     ||||||||||||||||||||||||||||||||||||||||||||||||||
1151 YRTPVLSAEASTGETPNLGEVVVAEVGWDALKLNWTAPEGAYEYFFIQVQ 1200

1201 EADTVEAAQNLTVPGGLRSTDLPGLKAATHYTITIRGVTQDFSTTPLSVE 1250
     ||||||||||||||||||||||||||||||||||||||||||||||||||
1201 EADTVEAAQNLTVPGGLRSTDLPGLKAATHYTITIRGVTQDFSTTPLSVE 1250

1251 VLTEEBPDMGNLTVTEVSWDALRLNWTTPDGTYDQFTIQVQEADQVEEAH 1300
     ||||||||||||||||||||||||||||||||||||||||||||||||||
1251 VLTEEBPDMGNLTVTEVSWDALRLNWTTPDGTYDQFTIQVQEADQVEEAH 1300

1301 NLTVPGSLRSMEIPGLRAGTPYTVTLHGEVRGHSTRPLAVEVVTEDLPQL 1350
     ||||||||||||||||||||||||||||||||||||||||||||||||||
1301 NLTVPGSLRSMEIPGLRAGTPYTVTLHGEVRGHSTRPLAVEVVTEDLPQL 1350

1351 GDLAVSEVGWDGLRLNWTAADNAYEHFVIQVQEVNKVEAAQNLTLPGSLR 1400
     ||||||||||||||||||||||||||||||||||||||||||||||||||
1351 GDLAVSEVGWDGLRLNWTAADNAYEHFVIQVQEVNKVEAAQNLTLPGSLR 1400

1401 AVDIPGLEAATPYRVSIYGVIRGYRTPVLSAEASTAKEPEIGNLNVSDIT 1450
     ||||||||||||||||||||||||||||||||||||||||||||||||||
1401 AVDIPGLEAATPYRVSIYGVIRGYRTPVLSAEASTAKEPEIGNLNVSDIT 1450

1451 PESFNLSWMATDGIFETFTIEIIDSNRLLETVEYNISGAERTAHISGLPP 1500
     ||||||||||||||||||||||||||||||||||||||||||||||||||
1451 PESFNLSWMATDGIFETFTIEIIDSNRLLETVEYNISGAERTAHISGLPP 1500

1501 STDFIVYLSGLAPSIRTKTISATATTEALPLLENLTISDINPYGFTVSWN 1550
     ||||||||||||||||||||||||||||||||||||||||||||||||||
1501 STDFIVYLSGLAPSIRTKTISATATTEALPLLENLTISDINPYGFTVSWN 1550

1551 ASENAFDSFLVTVVDSGKLLDPQEFTLSGTQRKLELRGLITGIGYEVMVS 1600
     ||||||||||||||||||||||||||||||||||||||||||||||||||
1551 ASENAFDSFLVTVVDSGKLLDPQEFTLSGTQRKLELRGLITGIGYEVMVS 1600

1601 GFTQGHQTKPLRAEIVTEAEPEVDNLLVSDATPDGFRLSWTADEGVFDNF 1650
     ||||||||||||||||||||||||||||||||||||||||||||||||||
1601 GFTQGHQTKPLRAEIVTEAEPEVDNLLVSDATPDGFRLSWTADEGVFDNF 1650

1651 VLKIRDTKKQSEPLEITLLAPERTRDLTGLREATEYEIELYGISKGRRSQ 1700
     ||||||||||||||||||||||||||||||||||||||||||||||||||
1651 VLKIRDTKKQSEPLEITLLAPERTRDLTGLREATEYEIELYGISKGRRSQ 1700

1701 TVSAIATTAMGSPKEVIFSDITENSATVSWRAPTAQVESFRITYVPITGG 1750
     ||||||||||||||||||||||||||||||||||||||||||||||||||
1701 TVSAIATTAMGSPKEVIFSDITENSATVSWRAPTAQVESFRITYVPITGG 1750

1751 TPSMVTVDGTKTQTRLVKLIPGVEYLVSIIAMKGFEESEPVSGSFTTALD 1800
     ||||||||||||||||||||||||||||||||||||||||||||||||||
1751 TPSMVTVDGTKTQTRLVKLIPGVEYLVSIIAMKGFEESEPVSGSFTTALD 1800

1801 GPSGLVTANITDSEALARWQPAIATVDSYVISYTGEKVPEITRTVSGNTV 1850
     ||||||||||||||||||||||||||||||||||||||||||||||||||
1801 GPSGLVTANITDSEALARWQPAIATVDSYVISYTGEKVPEITRTVSGNTV 1850

1851 EYALTDLEPATEYTLRIFAEKGPQKSSTITAKFTTDLDSPRDLTATEVQS 1900
     ||||||||||||||||||||||||||||||||||||||||||||||||||
1851 EYALTDLEPATEYTLRIFAEKGPQKSSTITAKFTTDLDSPRDLTATEVQS 1900

1901 ETALLTWRPPRASVTGYLLVYESVDGTVKEVIVGPDTTSYSLADLSPSTH 1950
     ||||||||||||||||||||||||||||||||||||||||||||||||||
1901 ETALLTWRPPRASVTGYLLVYESVDGTVKEVIVGPDTTSYSLADLSPSTH 1950

1951 YTAKIQALNGPLRSNMIQTIFTTIGLLYPFPKDCSQAMLNGDTTSGLYTI 2000
     ||||||||||||||||||||||||||||||||||||||||||||||||||
1951 YTAKIQALNGPLRSNMIQTIFTTIGLLYPFPKDCSQAMLNGDTTSGLYTI 2000
```

-continued

```
2001 YLNGDKAQALEVFCDMTSDGGGWIV                2025
     ||||||||||||||||||||||||
2001 YLNGDKAQALEVFCDMTSDGGGWIV                2025
```

Sequence name: TENA_HUMAN_V1

Sequence documentation:

Alignment of: HUMTEN_PEA_1_P15 (SEQ ID NO: 942) x TENA_HUMAN_V1 . . .

Alignment segment 1/1:
  Quality: 16391.00

Escore: 0
  Matching length: 1655 Total length: 2201

Matching Percent Similarity: 100.00 Matching Percent Identity: 100.00

Total Percent Similarity: 75.19 Total Percent Identity: 75.19

Gaps: 1

Alignment:

```
  1 MGAMTQLLAGVFLAFLALATEGGVLKKVIRHKRQSGVNATLPEENQPVVF   50
    ||||||||||||||||||||||||||||||||||||||||||||||||||
  1 MGAMTQLLAGVFLAFLALATEGGVLKKVIRHKRQSGVNATLPEENQPVVF   50

51 NHVYNIKLPVGSQCSVDLESASGEKDLAPPSEPSESFQEHTVDGENQIVF  100
    ||||||||||||||||||||||||||||||||||||||||||||||||||
 51 NHVYNIKLPVGSQCSVDLESASGEKDLAPPSEPSESFQEHTVDGENQIVF  100

101 THRINIPRRACGCAAAPDVKELLSRLEELENLVSSLREQCTAGAGCCLQP  150
    ||||||||||||||||||||||||||||||||||||||||||||||||||
101 THRINIPRRACGCAAAPDVKELLSRLEELENLVSSLREQCTAGAGCCLQP  150

151 ATGRLDTRPFCSGRGNFSTEGCGCVCEPGWKGPNCSEPECPGNCHLRGRC  200
    ||||||||||||| ||||||||||||||||||||||||||||||||||||
151 ATGRLDTRPGCSGRGNFSTEGCGCVCEPGWKGPNCSEPECPGNCHLRGRC  200

201 IDGQCICDDGFTGEDCSQLACPSDCNDQGKCVNGVCICFEGYAGADCSRE  250
    ||||||||||||||||||||||||||||||||||||||||||||||||||
201 IDGQCICDDGFTGEDCSQLACPSDCNDQGKCVNGVCICFEGYAGADCSRE  250

251 ICPVPCSEEHGTCVDGLCVCHDGFAGDDCNKPLCLNNCYNRGRCVENECV  300
    ||||||||||||||||||||||||||||||||||||||||||||||||||
251 ICPVPCSEEHGTCVDGLCVCHDGFAGDDCNKPLCLNNCYNRGRCVENECV  300

201 CDEGFTGEDCSELICPNDCFDRGRCINGTCYCEEGFTGEDCGKPTCPHAC  350
    ||||||||||||||||||||||||||||||||||||||||||||||||||
201 CDEGFTGEDCSELICPNDCFDRGRCINGTCYCEEGFTGEDCGKPTCPHAC  350

251 HTQGRCEEGQCVCDEGFAGVDCSEKRCPADCHNRGRCVDGRCECDDCFTG  400
    ||||||||||||||||||||||||||||||||||||||||||||||||||
251 HTQGRCEEGQCVCDEGFAGVDCSEKRCPADCHNRGRCVDGRCECDDGFTG  400

301 CDEGFTGEDCSELICPNDCFDRGRCINGTCYCEEGFTGEDCGKPTCPHAC  350
    ||||||||||||||||||||||||||||||||||||||||||||||||||
301 CDEGFTGEDCSELICPNDCFDRGRCINGTCYCEEGFTGEDCGKPTCPHAC  350

351 HTQGRCEEGQCVCDEGRAGVDCSEKRCPADCHNRGRCVDGRCECDDGFTG  400
    ||||||||||||||||||||||||||||||||||||||||||||||||||
351 HTQGRCEEGQCVCDEGFAGVDCSEKRCPADCHNRGRCVDGRCECDDGFTG  400

401 ADCGELKCPNGCSGHGRCVNGQCVCDEGYTGEDCSQLRCPNDCHSRGRCV  450
    ||||||||||||||||||||||||||||||||||||||||||||||||||
401 ADCGELKCPNGCSGHGRCVNGQCVCDEGYTGEDCSQLRCPNDCHSRGRCV  450

451 EGKCVCEQGFKGYDCSDMSCPNDCHQHGRCVNGMCVCDDGYTGEDCRDRQ  500
    ||||||||||||||||||||||||||||||||||||||||||||||||||
451 EGKCVCEQGFKGYDCSDMSCPNDCHQHGRCVNGMCVCDDGYTGEDCRDRQ  500

501 CPRDCSNRGLCVDGQCVCEDGFTGPDCAELSCPNDCHGRGRCVNGQCVCH  550
    ||||||||||||||||||||||||||||||||||||||||||||||||||
501 CPRDCSNRGLCVDGQCVCEDGFTGPDCAELSCPNDCHGRGRCVNGQCVCH  550

551 EGFMGKDCKEQRCPSDCHGQGRCVDGQCICHEGFTGLDCGQHSCPSDCNN  600
    ||||||||||||||||||||||||||||||||||||||||||||||||||
551 EGFMGKDCKEQRCPSDCHGQGRCVDGQCICHEGFTGLDCGQHSCPSDCNN  600
```

```
601  LGQCVSGRCICNEGYSGEDCSEVSPPKDLVVTEVTEETVNLAWDNEMRVT  650
     |||||||||||||||||||||||||||||||||||||||||||||||||
601  LGQCVSGRCICNEGYSGEDCSEVSPPKDLVVTEVTEETVNLAWDNEMRVT  650

651  EYLVVYTPTHEGGLEMQFRVPGDQTSTIIQELEPGVEYFIRVFAILENKK  700
     |||||||||||||||||||||||||||||||||||||||||||||||||
651  EYLVVYTPTHEGGLEMQFRVPGDQTSTIIQELEPGVEYFIRVFAILENKK  700

701  SIPVSARVATYLPAPEGLKFKSIKETSVEVEWDPLDIAFETWEIIFRNMN  750
     |||||||||||||||||||||||||||||||||||||||||||||||||
701  SIPVSARVATYLPAPEGLKFKSIKETSVEVEWDPLDIAFETWEIIFRNMN  750

751  KEDEGEITKSLRRPETSYRQTGLAPGQEYEISLHIVKNNTRGPGLKRVTT  800
     |||||||||||||||||||||||||||||||||||||||||||||||||
751  KEDEGEITKSLRRPETSYRQTGLAPGQEYEISLHIVKNNTRGPGLKRVTT  800

801  TRLDAPSQIEVKDVTDTTALITWFKPLAEIDGIELTYGIKDVPGDRTTID  850
     |||||||||||||||||||||||||||||||||||||||||||||||||
801  TRLDAPSQIEVKDVTDTTALITWFKPLAEIDGIELTYGIKDVPGDRTTID  850

851  LTEDENQYSIGNLKPDTEYEVSLISRRGDMSSNPAKETFTTGLDAPRNLR  900
     |||||||||||||||||||||||||||||||||||||||||||||||||
851  LTEDENQYSIGNLKPDTEYEVSLISRRGDMSSNPAKETFTTGLDAPRNLR  900

901  RVSQTDNSITLEWRNGKAAIDSYRIKYAPISGGDHAEVDVPKSQQATTKT  950
     |||||||||||||||||||||||||||||||||||||||||||||||||
901  RVSQTDNSITLEWRNGKAAIDSYRIKYAPISGGDHAEVDVPKSQQATTKT  950

951  TLTGLRPGTEYGIGVSAVKEDKESNPATINAATELDTPKDLQVSETAETS  1000
     |||||||||||||||||||||||||||||||||||||||||||||||||
951  TLTGLRPGTEYGIGVSAVKEDKESNPATINAATELDTPKDLQVSETAETS  1000

1001 LTLLWKTPLAKFDRYRLNYSLPTGQWVGVQLPRNTTSYVLRGLEPGQEYN  1050
     |||||||||||||||||||||||||||||||||||||||||||||||||
1001 LTLLWKTPLAKFDRYRLNYSLPTGQWVGVQLPRNTTSYVLRGLEPGQEYN  1050

1051 VLLTAEKGRHKSKPARVKAS............................  1070
     ||||||||||||||||||||
1051 VLLTAEKGRHKSKPARVKASTEQAPELENLTVTEVGWDGLRLNWTAADQA  1100

1070 .................................................  1070

1101 YEHFIIQVQEANKVEAARNLTVPGSLRAVDIPGLKAATPYTVSIYGVIQG  1150

1070 .................................................  1070

1151 YRTPVLSAEASTGETPNLGEVVVAEVGWDALKLNWTAPEGAYEYFFIQVQ  1200

1070 .................................................  1070

1201 EADTVEAAQNLTVPGGLRSTDLPGLKAATHYTITIRGVTQDFSTTPLSVE  1250

1070 .................................................  1070

1251 VLTEEBPDMGNLTVTEVSWDALRLNWTTPDGTYDQFTIQVQEADQVEEAH  1300

1070 .................................................  1070

1301 NLTVPGSLRSMEIPGLRAGTPYTVTLHGEVRGHSTRPLAVEVVTEDLPQL  1350

1070 .................................................  1070

1351 GDLAVSEVGWDGLRLNWTAADNAYEHFVIQVQEVNKVEAAQNLTLPGSLR  1400

1070 .................................................  1070

1401 AVDIPGLEAATPYRVSIYGVIRGYRTPVLSAEASTAKEPEIGNLNVSDIT  1450

1070 .................................................  1070

1451 PESFNLSWMATDGIFETFTIEIIDSNRLLETVEYNISGAERTAHISGLPP  1500

1070 .................................................  1070

1501 STDFIVYLSGLAPSIRTKTISATATTEALPLLENLTISDINPYGFTVSWN  1550

1070 .................................................  1070

1551 ASENAFDSFLVTVVDSGKLLDPQEFTLSGTQRKLELRGLITGIGYEVMVS  1600
```

-continued

```
1071   ................TEAEPEVDNLLVSDATPDGFRLSWTADEGVFDNF  1650
                       ||||||||||||||||||||||||||||||||||
1601   GFTQGHQTKPLRAEIVTEAEPEVDNLLVSDATPDGFRLSWTADEGVFDNF  1650

1105   VLKIRDTKKQSEPLEITLLAPERTRDLTGLREATEYEIELYGISKGRRSQ  1154
       ||||||||||||||||||||||||||||||||||||||||||||||||||
1651   VLKIRDTKKQSEPLEITLLAPERTRDLTGLREATEYEIELYGISKGRRSQ  1700

1155   TVSAIATTAMGSPKEVIFSDITENSATVSWRAPTAQVESFRITYVPITGG  1204
       ||||||||||||||||||||||||||||||||||||||||||||||||||
1701   TVSAIATTAMGSPKEVIFSDITENSATVSWRAPTAQVESFRITYVPITGG  1750

1205   TPSMVTVDGTKTQTRLVKLIPGVEYLVSIIAMKGFEESEPVSGSFTTALD  1254
       ||||||||||||||||||||||||||||||||||||||||||||||||||
1751   TPSMVTVDGTKTQTRLVKLIPGVEYLVSIIAMKGFEESEPVSGSFTTALD  1800

1255   GPSGLVTANITDSEALARWQPAIATVDSYVISYTGEKVPEITRTVSGNTV  1304
       ||||||||||||||||||||||||||||||||||||||||||||||||||
1801   GPSGLVTANITDSEALARWQPAIATVDSYVISYTGEKVPEITRTVSGNTV  1850

1305   EYALTDLEPATEYTLRIFAEKGPQKSSTITAKFTTDLDSPRDLTATEVQS  1354
       ||||||||||||||||||||||||||||||||||||||||||||||||||
1851   EYALTDLEPATEYTLRIFAEKGPQKSSTITAKFTTDLDSPRDLTATEVQS  1900

1355   ETALLTWRPPRASVTGYLLVYESVDGTVKEVIVGPDTTSYSLADLSPSTH  1404
       ||||||||||||||||||||||||||||||||||||||||||||||||||
1901   ETALLTWRPPRASVTGYLLVYESVDGTVKEVIVGPDTTSYSLADLSPSTH  1950

1405   YTAKIQALNGPLRSNMIQTIFTTIGLLYPFPKDCSQAMLNGDTTSGLYTI  1454
       ||||||||||||||||||||||||||||||||||||||||||||||||||
1951   YTAKIQALNGPLRSNMIQTIFTTIGLLYPFPKDCSQAMLNGDTTSGLYTI  2000

1455   YLNGDKAQALEVFCDMTSDGGGWIVFLRRKNGRENFYQNWKAYAAGFGDR  1504
       ||||||||||||||||||||||||||||||||||||||||||||||||||
2001   YLNGDKAQALEVFCDMTSDGGGWIVFLRRKNGRENFYQNWKAYAAGFGDR  2050

1505   REEFWLGLDNLNKITAQGQYELRVDLRDHGETAFAVYDKFSVGDAKTRYK  1554
       ||||||||||||||||||||||||||||||||||||||||||||||||||
2051   REEFWLGLDNLNKITAQGQYELRVDLRDHGETAFAVYDKFSVGDAKTRYK  2100

1555   LKVEGYSGTAGDSMAYHNGRSFSTFDKDTDSAITNCALSYKGAFWYRNCH  1604
       ||||||||||||||||||||||||||||||||||||||||||||||||||
2101   LKVEGYSGTAGDSMAYHNGRSFSTFDKDTDSAITNCALSYKGAFWYRNCH  2150

1605   RVNLMGRYGDNNHSQGVNWFHWKGHEHSIQFAEMKLRPSNFRNLEGRRKR  1654
       ||||||||||||||||||||||||||||||||||||||||||||||||||
2151   RVNLMGRYGDNNHSQGVNWFHWKGHEHSIQFAEMKLRPSNFRNLEGRRKR  2200
1655   A                                                 1655
       |
2201   A                                                 2201
```

Sequence name: TENA_HUMAN_V1

Sequence documentation:

Alignment of: HUMTEN_PEA_1_P16 (SEQ ID NO: 943) x TENA_HUMAN_V1 . . .

Alignment segment 1/1:
  Quality: 15530.00

Escore: 0
  Matching length: 1564 Total length: 2201

Matching Percent Similarity: 100.00 Matching Percent Identity: 100.00

Total Percent Similarity: 71.06 Total Percent Identity: 71.06

Gaps: 1

Alignment:

```
  1   MGAMTQLLAGVFLAFLALATEGGVLKKVIRHKRQSGVNATLPEENQPVVF   50
      |||||||||||||||||||||||||||||||||||||||||||||||||| 
  1   MGAMTQLLAGVFLAFLALATEGGVLKKVIRHKRQSGVNATLPEENQPVVF   50

51   NHVYNIKLPVGSQCSVDLESASGEKDLAPPSEPSESFQEHTVDGENQIVF  100
      ||||||||||||||||||||||||||||||||||||||||||||||||||
 51   NHVYNIKLPVGSQCSVDLESASGEKDLAPPSEPSESFQEHTVDGENQIVF  100

101   THRINIPRRACGCAAAPDVKELLSRLEELENLVSSLREQCTAGAGCCLQP  150
      ||||||||||||||||||||||||||||||||||||||||||||||||||
101   THRINIPRRACGCAAAPDVKELLSRLEELENLVSSLREQCTAGAGCCLQP  150
```

-continued

```
 151 ATGRLDTRPFCSGRGNFSTEGCGCVCEPGWKGPNCSEPECPGNCHLRGRC  200
     ||||||||||||||||||||||||||||||||||||||||||||||||||
 151 ATGRLDTRPGCSGRGNFSTEGCGCVCEPGWKGPNCSEPECPGNCHLRGRC  200

201 IDGQCICDDGFTGEDCSQLACPSDCNDQGKCVNGVCICFEGYAGADCSRE  250
     ||||||||||||||||||||||||||||||||||||||||||||||||||
 201 IDGQCICDDGFTGEDCSQLACPSDCNDQGKCVNGVCICFEGYAGADCSRE  250

251 ICPVPCSEEHGTCVDGLCVCHDGFAGDDCNKPLCLNNCYNRGRCVENECV  300
     ||||||||||||||||||||||||||||||||||||||||||||||||||
 251 ICPVPCSEEHGTCVDGLCVCHDGFAGDDCNKPLCLNNCYNRGRCVENECV  300

201 CDEGFTGEDCSELICPNDCFDRGRCINGTCYCEEGFTGEDCGKPTCPHAC  350
     ||||||||||||||||||||||||||||||||||||||||||||||||||
 201 CDEGFTGEDCSELICPNDCFDRGRCINGTCYCEEGFTGEDCGKPTCPHAC  350

251 HTQGRCEEGQCVCDEGFAGVDCSEKRCPADCHNRGRCVDGRCECDDCFTG  400
     ||||||||||||||||||||||||||||||||||||||||||||||||||
 251 HTQGRCEEGQCVCDEGFAGVDCSEKRCPADCHNRGRCVDGRCECDDGFTG  400

301 CDEGFTGEDCSELICPNDCFDRGRCINGTCYCEEGFTGEDCGKPTCPHAC  350
     ||||||||||||||||||||||||||||||||||||||||||||||||||
 301 CDEGFTGEDCSELICPNDCFDRGRCINGTCYCEEGFTGEDCGKPTCPHAC  350

351 HTQGRCEEGQCVCDEGRAGVDCSEKRCPADCHNRGRCVDGRCECDDGFTG  400
     ||||||||||||||||||||||||||||||||||||||||||||||||||
 351 HTQGRCEEGQCVCDEGFAGVDCSEKRCPADCHNRGRCVDGRCECDDGFTG  400

401 ADCGELKCPNGCSGHGRCVNGQCVCDEGYTGEDCSQLRCPNDCHSRGRCV  450
     ||||||||||||||||||||||||||||||||||||||||||||||||||
 401 ADCGELKCPNGCSGHGRCVNGQCVCDEGYTGEDCSQLRCPNDCHSRGRCV  450

451 EGKCVCEQGFKGYDCSDMSCPNDCHQHGRCVNGMCVCDDGYTGEDCRDRQ  500
     ||||||||||||||||||||||||||||||||||||||||||||||||||
 451 EGKCVCEQGFKGYDCSDMSCPNDCHQHGRCVNGMCVCDDGYTGEDCRDRQ  500

501 CPRDCSNRGLCVDGQCVCEDGFTGPDCAELSCPNDCHGRGRCVNGQCVCH  550
     ||||||||||||||||||||||||||||||||||||||||||||||||||
 501 CPRDCSNRGLCVDGQCVCEDGFTGPDCAELSCPNDCHGRGRCVNGQCVCH  550

551 EGFMGKDCKEQRCPSDCHGQGRCVDGQCICHEGFTGLDCGQHSCPSDCNN  600
     ||||||||||||||||||||||||||||||||||||||||||||||||||
 551 EGFMGKDCKEQRCPSDCHGQGRCVDGQCICHEGFTGLDCGQHSCPSDCNN  600

601 LGQCVSGRCICNEGYSGEDCSEVSPPKDLVVTEVTEETVNLAWDNEMRVT  650
     ||||||||||||||||||||||||||||||||||||||||||||||||||
 601 LGQCVSGRCICNEGYSGEDCSEVSPPKDLVVTEVTEETVNLAWDNEMRVT  650

651 EYLVVYTPTHEGGLEMQFRVPGDQTSTIIQELEPGVEYFIRVFAILENKK  700
     ||||||||||||||||||||||||||||||||||||||||||||||||||
 651 EYLVVYTPTHEGGLEMQFRVPGDQTSTIIQELEPGVEYFIRVFAILENKK  700

701 SIPVSARVATYLPAPEGLKFKSIKETSVEVEWDPLDIAFETWEIIFRNMN  750
     ||||||||||||||||||||||||||||||||||||||||||||||||||
 701 SIPVSARVATYLPAPEGLKFKSIKETSVEVEWDPLDIAFETWEIIFRNMN  750

751 KEDEGEITKSLRRPETSYRQTGLAPGQEYEISLHIVKNNTRGPGLKRVTT  800
     ||||||||||||||||||||||||||||||||||||||||||||||||||
 751 KEDEGEITKSLRRPETSYRQTGLAPGQEYEISLHIVKNNTRGPGLKRVTT  800

801 TRLDAPSQIEVKDVTDTTALITWFKPLAEIDGIELTYGIKDVPGDRTTID  850
     ||||||||||||||||||||||||||||||||||||||||||||||||||
 801 TRLDAPSQIEVKDVTDTTALITWFKPLAEIDGIELTYGIKDVPGDRTTID  850

851 LTEDENQYSIGNLKPDTEYEVSLISRRGDMSSNPAKETFTTGLDAPRNLR  900
     ||||||||||||||||||||||||||||||||||||||||||||||||||
 851 LTEDENQYSIGNLKPDTEYEVSLISRRGDMSSNPAKETFTTGLDAPRNLR  900

901 RVSQTDNSITLEWRNGKAAIDSYRIKYAPISGGDHAEVDVPKSQQATTKT  950
     ||||||||||||||||||||||||||||||||||||||||||||||||||
 901 RVSQTDNSITLEWRNGKAAIDSYRIKYAPISGGDHAEVDVPKSQQATTKT  950

951 TLTGLRPGTEYGIGVSAVKEDKESNPATINAATELDTPKDLQVSETAETS 1000
     ||||||||||||||||||||||||||||||||||||||||||||||||||
 951 TLTGLRPGTEYGIGVSAVKEDKESNPATINAATELDTPKDLQVSETAETS 1000

1001 LTLLWKTPLAKFDRYRLNYSLPTGQWVGVQLPRNTTSYVLRGLEPGQEYN 1050
     ||||||||||||||||||||||||||||||||||||||||||||||||||
1001 LTLLWKTPLAKFDRYRLNYSLPTGQWVGVQLPRNTTSYVLRGLEPGQEYN 1050
```

```
-continued
1051  VLLTAEKGRHKSKPARVKAS............................  1070
      ||||||||||||||||||||
1051  VLLTAEKGRHKSKPARVKASTEQAPELENLTVTEVGWDGLRLNWTAADQA  1100

1070  ..................................................  1070
1101  YEHFIIQVQEANKVEAARNLTVPGSLRAVDIPGLKAATPYTVSIYGVIQG  1150

1070  ..................................................  1070
1151  YRTPVLSAEASTGETPNLGEVVVAEVGWDALKLNWTAPEGAYEYFFIQVQ  1200

1070  ..................................................  1070
1201  EADTVEAAQNLTVPGGLRSTDLPGLKAATHYTITIRGVTQDFSTTPLSVE  1250

1070  ..................................................  1070
1251  VLTEEBPDMGNLTVTEVSWDALRLNWTTPDGTYDQFTIQVQEADQVEEAH  1300

1070  ..................................................  1070
1301  NLTVPGSLRSMEIPGLRAGTPYTVTLHGEVRGHSTRPLAVEVVTEDLPQL  1350

1070  ..................................................  1070
1351  GDLAVSEVGWDGLRLNWTAADNAYEHFVIQVQEVNKVEAAQNLTLPGSLR  1400

1070  ..................................................  1070
1401  AVDIPGLEAATPYRVSIYGVIRGYRTPVLSAEASTAKEPEIGNLNVSDIT  1450

1070  ..................................................  1070
1451  PESFNLSWMATDGIFETFTIEIIDSNRLLETVEYNISGAERTAHISGLPP  1500

1070  ..................................................  1070
1501  STDFIVYLSGLAPSIRTKTISATATTEALPLLENLTISDINPYGFTVSWN  1550

1070  ..................................................  1070
1551  ASENAFDSFLVTVVDSGKLLDPQEFTLSGTQRKLELRGLITGIGYEVMVS  1600

1071  ..................................................  1650
1601  GFTQGHQTKPLRAEIVTEAEPEVDNLLVSDATPDGFRLSWTADEGVFDNF  1650

1071  ..................................................  1650
1651  VLKIRDTKKQSEPLEITLLAPERTRDLTGLREATEYEIELYGISKGRRSQ  1700

1071  .......TAMGSPKEVIFSDITENSATVSWRAPTAQVESFRITYVPITGG  1113
             ||||||||||||||||||||||||||||||||||||||||||
1701  TVSAIATTAMGSPKEVIFSDITENSATVSWRAPTAQVESFRITYVPITGG  1750

1114  TPSMVTVDGTKTQTRLVKLIPGVEYLVSIIAMKGFEESEPVSGSFTTALD  1163
      |||||||||||||||||||||||||||||||||||||||||||||||||
1751  TPSMVTVDGTKTQTRLVKLIPGVEYLVSIIAMKGFEESEPVSGSFTTALD  1800

1164  GPSGLVTANITDSEALARWQPAIATVDSYVISYTGEKVPEITRTVSGNTV  1213
      |||||||||||||||||||||||||||||||||||||||||||||||||
1801  GPSGLVTANITDSEALARWQPAIATVDSYVISYTGEKVPEITRTVSGNTV  1850

1214  EYALTDLEPATEYTLRIFAEKGPQKSSTITAKFTTDLDSPRDLTATEVQS  1263
      |||||||||||||||||||||||||||||||||||||||||||||||||
1851  EYALTDLEPATEYTLRIFAEKGPQKSSTITAKFTTDLDSPRDLTATEVQS  1900

1264  ETALLTWRPPRASVTGYLLVYESVDGTVKEVIVGPDTTSYSLADLSPSTH  1313
      |||||||||||||||||||||||||||||||||||||||||||||||||
1901  ETALLTWRPPRASVTGYLLVYESVDGTVKEVIVGPDTTSYSLADLSPSTH  1950

1314  YTAKIQALNGPLRSNMIQTIFTTIGLLYPFPKDCSQAMLNGDTTSGLYTI  1363
      |||||||||||||||||||||||||||||||||||||||||||||||||
1951  YTAKIQALNGPLRSNMIQTIFTTIGLLYPFPKDCSQAMLNGDTTSGLYTI  2000

1364  YLNGDKAQALEVFCDMTSDGGGWIVFLRRKNGRENFYQNWKAYAAGFGDR  1413
      |||||||||||||||||||||||||||||||||||||||||||||||||
2001  YLNGDKAQALEVFCDMTSDGGGWIVFLRRKNGRENFYQNWKAYAAGFGDR  2050
```

-continued

```
1414  REEFWLGLDNLNKITAQGQYELRVDLRDHGETAFAVYDKFSVGDAKTRYK  1463
      ||||||||||||||||||||||||||||||||||||||||||||||||||
2051  REEFWLGLDNLNKITAQGQYELRVDLRDHGETAFAVYDKFSVGDAKTRYK  2100

1464  LKVEGYSGTAGDSMAYHNGRSFSTFDKDTDSAITNCALSYKGAFWYRNCH  1513
      ||||||||||||||||||||||||||||||||||||||||||||||||||
2101  LKVEGYSGTAGDSMAYHNGRSFSTFDKDTDSAITNCALSYKGAFWYRNCH  2150

1514  RVNLMGRYGDNNHSQGVNWFHWKGHEHSIQFAEMKLRPSNFRNLEGRRKR  1563
      ||||||||||||||||||||||||||||||||||||||||||||||||||
2151  RVNLMGRYGDNNHSQGVNWFHWKGHEHSIQFAEMKLRPSNFRNLEGRRKR  2200

1564  A                                                   1564
      |
2201  A                                                   2201
```

Sequence name: TENA_HUMAN_V1

Sequence documentation:

Alignment of: HUMTEN_PEA__1_P17 (SEQ ID NO: 944) x TENA_HUMAN_V1 . . .

Alignment segment 1/1:
 Quality: 19930.00

Escore: 0
 Matching length: 2025 Total length: 2025

Matching Percent Similarity: 100.00 Matching Percent Identity: 100.00

Total Percent Similarity: 100.00 Total Percent Identity: 100.00

Gaps: 0

Alignment:

```
  1  MGAMTQLLAGVFLAFLALATEGGVLKKVIRHKRQSGVNATLPEENQPVVF   50
     ||||||||||||||||||||||||||||||||||||||||||||||||||
  1  MGAMTQLLAGVFLAFLALATEGGVLKKVIRHKRQSGVNATLPEENQPVVF   50

51  NHVYNIKLPVGSQCSVDLESASGEKDLAPPSEPSESFQEHTVDGENQIVF  100
     ||||||||||||||||||||||||||||||||||||||||||||||||||
 51  NHVYNIKLPVGSQCSVDLESASGEKDLAPPSEPSESFQEHTVDGENQIVF  100

101  THRINIPRRACGCAAAPDVKELLSRLEELENLVSSLREQCTAGAGCCLQP  150
     ||||||||||||||||||||||||||||||||||||||||||||||||||
101  THRINIPRRACGCAAAPDVKELLSRLEELENLVSSLREQCTAGAGCCLQP  150

151  ATGRLDTRPPCSGRGNFSTEGCGCVCEPGWKGPNCSEPECPGNCHLRGRC  200
     ||||||||||||||||||||||||||||||||||||||||||||||||||
151  ATGRLDTRPGCSGRGNFSTEGCGCVCEPGWKGPNCSEPECPGNCHLRGRC  200

201  IDGQCICDDGFTGEDCSQLACPSDCNDQGKCVNGVCICFEGYAGADCSRE  250
     ||||||||||||||||||||||||||||||||||||||||||||||||||
201  IDGQCICDDGFTGEDCSQLACPSDCNDQGKCVNGVCICFEGYAGADCSRE  250

251  ICPVPCSEEHGTCVDGLCVCHDGFAGDDCNKPLCLNNCYNRGRCVENECV  300
     ||||||||||||||||||||||||||||||||||||||||||||||||||
251  ICPVPCSEEHGTCVDGLCVCHDGFAGDDCNKPLCLNNCYNRGRCVENECV  300

201  CDEGFTGEDCSELICPNDCFDRGRCINGTCYCEEGFTGEDCGKPTCPHAC  350
     ||||||||||||||||||||||||||||||||||||||||||||||||||
201  CDEGFTGEDCSELICPNDCFDRGRCINGTCYCEEGFTGEDCGKPTCPHAC  350

251  HTQGRCEEGQCVCDEGFAGVDCSEKRCPADCHNRGRCVDGRCECDDCFTG  400
     ||||||||||||||||||||||||||||||||||||||||||||||||||
251  HTQGRCEEGQCVCDEGFAGVDCSEKRCPADCHNRGRCVDGRCECDDGFTG  400

301  CDEGFTGEDCSELICPNDCFDRGRCINGTCYCEEGFTGEDCGKPTCPHAC  350
     ||||||||||||||||||||||||||||||||||||||||||||||||||
301  CDEGFTGEDCSELICPNDCFDRGRCINGTCYCEEGFTGEDCGKPTCPHAC  350

351  HTQGRCEEGQCVCDEGRAGVDCSEKRCPADCHNRGRCVDGRCECDDGFTG  400
     ||||||||||||||||||||||||||||||||||||||||||||||||||
351  HTQGRCEEGQCVCDEGFAGVDCSEKRCPADCHNRGRCVDGRCECDDGFTG  400

401  ADCGELKCPNGCSGHGRCVNGQCVCDEGYTGEDCSQLRCPNDCHSRGRCV  450
     ||||||||||||||||||||||||||||||||||||||||||||||||||
401  ADCGELKCPNGCSGHGRCVNGQCVCDEGYTGEDCSQLRCPNDCHSRGRCV  450

451  EGKCVCEQGFKGYDCSDMSCPNDCHQHGRCVNGMCVCDDGYTGEDCRDRQ  500
     ||||||||||||||||||||||||||||||||||||||||||||||||||
451  EGKCVCEQGFKGYDCSDMSCPNDCHQHGRCVNGMCVCDDGYTGEDCRDRQ  500
```

```
501  CPRDCSNRGLCVDGQCVEDGFTGPDCAELSCPNDCHGRGRCVNGQCVCH  550
     ||||||||||||||||||||||||||||||||||||||||||||||||
501  CPRDCSNRGLCVDGQCVEDGFTGPDCAELSCPNDCHGRGRCVNGQCVCH  550

551  EGFMGKDCKEQRCPSDCHGQGRCVDGQCICHEGFTGLDCGQHSCPSDCNN  600
     ||||||||||||||||||||||||||||||||||||||||||||||||
551  EGFMGKDCKEQRCPSDCHGQGRCVDGQCICHEGFTGLDCGQHSCPSDCNN  600

601  LGQCVSGRCICNEGYSGEDCSEVSPPKDLVVTEVTEETVNLAWDNEMRVT  650
     ||||||||||||||||||||||||||||||||||||||||||||||||
601  LGQCVSGRCICNEGYSGEDCSEVSPPKDLVVTEVTEETVNLAWDNEMRVT  650

651  EYLVVYTPTHEGGLEMQFRVPGDQTSTIIQELEPGVEYFIRVFAILENKK  700
     ||||||||||||||||||||||||||||||||||||||||||||||||
651  EYLVVYTPTHEGGLEMQFRVPGDQTSTIIQELEPGVEYFIRVFAILENKK  700

701  SIPVSARVATYLPAPEGLKFKSIKETSVEVEWDPLDIAFETWEIIFRNMN  750
     ||||||||||||||||||||||||||||||||||||||||||||||||
701  SIPVSARVATYLPAPEGLKFKSIKETSVEVEWDPLDIAFETWEIIFRNMN  750

751  KEDEGEITKSLRRPETSYRQTGLAPGQEYEISLHIVKNNTRGPGLKRVTT  800
     ||||||||||||||||||||||||||||||||||||||||||||||||
751  KEDEGEITKSLRRPETSYRQTGLAPGQEYEISLHIVKNNTRGPGLKRVTT  800

801  TRLDAPSQIEVKDVTDTTALITWFKPLAEIDGIELTYGIKDVPGDRTTID  850
     ||||||||||||||||||||||||||||||||||||||||||||||||
801  TRLDAPSQIEVKDVTDTTALITWFKPLAEIDGIELTYGIKDVPGDRTTID  850

851  LTEDENQYSIGNLKPDTEYEVSLISRRGDMSSNPAKETFTTGLDAPRNLR  900
     ||||||||||||||||||||||||||||||||||||||||||||||||
851  LTEDENQYSIGNLKPDTEYEVSLISRRGDMSSNPAKETFTTGLDAPRNLR  900

901  RVSQTDNSITLEWRNGKAAIDSYRIKYAPISGGDHAEVDVPKSQQATTKT  950
     ||||||||||||||||||||||||||||||||||||||||||||||||
901  RVSQTDNSITLEWRNGKAAIDSYRIKYAPISGGDHAEVDVPKSQQATTKT  950

951  TLTGLRPGTEYGIGVSAVKEDKESNPATINAATELDTPKDLQVSETAETS  1000
     ||||||||||||||||||||||||||||||||||||||||||||||||
951  TLTGLRPGTEYGIGVSAVKEDKESNPATINAATELDTPKDLQVSETAETS  1000

1001 LTLLWKTPLAKFDRYRLNYSLPTGQWVGVQLPRNTTSYVLRGLEPGQEYN  1050
     ||||||||||||||||||||||||||||||||||||||||||||||||
1001 LTLLWKTPLAKFDRYRLNYSLPTGQWVGVQLPRNTTSYVLRGLEPGQEYN  1050

1051 VLLTAEKGRHKSKPARVKASTEQAPELENLTVTEVGWDGLRLNWTAADQA  1100
     ||||||||||||||||||||||||||||||||||||||||||||||||
1051 VLLTAEKGRHKSKPARVKASTEQAPELENLTVTEVGWDGLRLNWTAADQA  1100

1101 YEHFIIQVQEANKVEAARNLTVPGSLRAVDIPGLKAATPYTVSIYGVIQG  1150
     ||||||||||||||||||||||||||||||||||||||||||||||||
1101 YEHFIIQVQEANKVEAARNLTVPGSLRAVDIPGLKAATPYTVSIYGVIQG  1150

1151 YRTPVLSAEASTGETPNLGEVVVAEVGWDALKLNWTAPEGAYEYFFIQVQ  1200
     ||||||||||||||||||||||||||||||||||||||||||||||||
1151 YRTPVLSAEASTGETPNLGEVVVAEVGWDALKLNWTAPEGAYEYFFIQVQ  1200

1201 EADTVEAAQNLTVPGGLRSTDLPGLKAATHYTITIRGVTQDFSTTPLSVE  1250
     ||||||||||||||||||||||||||||||||||||||||||||||||
1201 EADTVEAAQNLTVPGGLRSTDLPGLKAATHYTITIRGVTQDFSTTPLSVE  1250

1251 VLTEEBPDMGNLTVTEVSWDALRLNWTTPDGTYDQFTIQVQEADQVEEAH  1300
     ||||||||||||||||||||||||||||||||||||||||||||||||
1251 VLTEEBPDMGNLTVTEVSWDALRLNWTTPDGTYDQFTIQVQEADQVEEAH  1300

1301 NLTVPGSLRSMEIPGLRAGTPYTVTLHGEVRGHSTRPLAVEVVTEDLPQL  1350
     ||||||||||||||||||||||||||||||||||||||||||||||||
1301 NLTVPGSLRSMEIPGLRAGTPYTVTLHGEVRGHSTRPLAVEVVTEDLPQL  1350

1351 GDLAVSEVGWDGLRLNWTAADNAYEHFVIQVQEVNKVEAAQNLTLPGSLR  1400
     ||||||||||||||||||||||||||||||||||||||||||||||||
1351 GDLAVSEVGWDGLRLNWTAADNAYEHFVIQVQEVNKVEAAQNLTLPGSLR  1400

1401 AVDIPGLEAATPYRVSIYGVIRGYRTPVLSAEASTAKEPEIGNLNVSDIT  1450
     ||||||||||||||||||||||||||||||||||||||||||||||||
1401 AVDIPGLEAATPYRVSIYGVIRGYRTPVLSAEASTAKEPEIGNLNVSDIT  1450

1451 PESFNLSWMATDGIFETFTIEIIDSNRLLETVEYNISGAERTAHISGLPP  1500
     ||||||||||||||||||||||||||||||||||||||||||||||||
1451 PESFNLSWMATDGIFETFTIEIIDSNRLLETVEYNISGAERTAHISGLPP  1500
```

-continued

```
1501  STDFIVYLSGLAPSIRTKTISATATTEALPLLENLTISDINPYGFTVSWN  1550
      ||||||||||||||||||||||||||||||||||||||||||||||||||
1501  STDFIVYLSGLAPSIRTKTISATATTEALPLLENLTISDINPYGFTVSWN  1550

1551  ASENAFDSFLVTVVDSGKLLDPQEFTLSGTQRKLELRGLITGIGYEVMVS   1600
      |||||||||||||||||||||||||||||||||||||||||||||||||
1551  ASENAFDSFLVTVVDSGKLLDPQEFTLSGTQRKLELRGLITGIGYEVMVS   1600

1601  GFTQGHQTKPLRAEIVTEAEPEVDNLLVSDATPDGFRLSWTADEGVFDNF   1650
      |||||||||||||||||||||||||||||||||||||||||||||||||
1601  GFTQGHQTKPLRAEIVTEAEPEVDNLLVSDATPDGFRLSWTADEGVFDNF   1650

1651  VLKIRDTKKQSEPLEITLLAPERTRDLTGLREATEYEIELYGISKGRRSQ   1700
      |||||||||||||||||||||||||||||||||||||||||||||||||
1651  VLKIRDTKKQSEPLEITLLAPERTRDLTGLREATEYEIELYGISKGRRSQ   1700

1701  TVSAIATTAMGSPKEVIFSDITENSATVSWRAPTAQVESFRITYVPITGG   1750
      |||||||||||||||||||||||||||||||||||||||||||||||||
1701  TVSAIATTAMGSPKEVIFSDITENSATVSWRAPTAQVESFRITYVPITGG   1750

1751  TPSMVTVDGTKTQTRLVKLIPGVEYLVSIIAMKGFEESEPVSGSFTTALD   1800
      |||||||||||||||||||||||||||||||||||||||||||||||||
1751  TPSMVTVDGTKTQTRLVKLIPGVEYLVSIIAMKGFEESEPVSGSFTTALD   1800

1801  GPSGLVTANITDSEALARWQPAIATVDSYVISYTGEKVPEITRTVSGNTV   1850
      |||||||||||||||||||||||||||||||||||||||||||||||||
1801  GPSGLVTANITDSEALARWQPAIATVDSYVISYTGEKVPEITRTVSGNTV   1850

1851  EYALTDLEPATEYTLRIFAEKGPQKSSTITAKFTTDLDSPRDLTATEVQS   1900
      |||||||||||||||||||||||||||||||||||||||||||||||||
1851  EYALTDLEPATEYTLRIFAEKGPQKSSTITAKFTTDLDSPRDLTATEVQS   1900

1901  ETALLTWRPPRASVTGYLLVYESVDGTVKEVIVGPDTTSYSLADLSPSTH   1950
      |||||||||||||||||||||||||||||||||||||||||||||||||
1901  ETALLTWRPPRASVTGYLLVYESVDGTVKEVIVGPDTTSYSLADLSPSTH   1950

1951  YTAKIQALNGPLRSNMIQTIFTTIGLLYPFPKDCSQAMLNGDTTSGLYTI   2000
      |||||||||||||||||||||||||||||||||||||||||||||||||
1951  YTAKIQALNGPLRSNMIQTIFTTIGLLYPFPKDCSQAMLNGDTTSGLYTI   2000

2001  YLNGDKAQALEVFCDMTSDGGGWIV                            2025
      |||||||||||||||||||||||||
2001  YLNGDKAQALEVFCDMTSDGGGWIV                            2025
```

Sequence name: TENA_HUMAN_V1

Sequence documentation:

Alignment of: HUMTEN_PEA_1_P20 (SEQ ID NO: 945) x TENA_HUMAN_V1 ...

Alignment segment 1/1:
  Quality: 20262.00
Escore: 0
  Matching length: 2057 Total length: 2057

Matching Percent Similarity: 100.00 Matching Percent Identity: 100.00
  Total Percent Similarity: 100.00 Total Percent Identity: 100.00
  Gaps: 0

Alignment:

```
  1  MGAMTQLLAGVFLAFLALATEGGVLKKVIRHKRQSGVNATLPEENQPVVF   50
     |||||||||||||||||||||||||||||||||||||||||||||||||
  1  MGAMTQLLAGVFLAFLALATEGGVLKKVIRHKRQSGVNATLPEENQPVVF   50

51  NHVYNIKLPVGSQCSVDLESASGEKDLAPPSEPSESFQEHTVDGENQIVF  100
     |||||||||||||||||||||||||||||||||||||||||||||||||
 51  NHVYNIKLPVGSQCSVDLESASGEKDLAPPSEPSESFQEHTVDGENQIVF  100

101  THRINIPRRACGCAAAPDVKELLSRLEELENLVSSLREQCTAGAGCCLQP  150
     |||||||||||||||||||||||||||||||||||||||||||||||||
101  THRINIPRRACGCAAAPDVKELLSRLEELENLVSSLREQCTAGAGCCLQP  150

151  ATGRLDTRPFCSGRGNFSTEGCGCVCEPGWKGPNCSEPECPGNCHLRGRC  200
     |||||||||||||||||||||||||||||||||||||||||||||||||
151  ATGRLDTRPFCSGRGNFSTEGCGCVCEPGWKGPNCSEPECPGNCHLRGRC  200
```

```
201  IDGQCICDDGFTGEDCSQLACPSDCNDQGKCVNGVCIFEGYAGADCSRE  250
     ||||||||||||||||||||||||||||||||||||||||||||||||||
201  IDGQCICDDGFTGEDCSQLACPSDCNDQGKCVNGVCIFEGYAGADCSRE  250

251  ICPVPCSEEHGTCVDGLCVCHDGFAGDDCNKPLCLNNCYNRGRCVENECV  300
     ||||||||||||||||||||||||||||||||||||||||||||||||||
251  ICPVPCSEEHGTCVDGLCVCHDGFAGDDCNKPLCLNNCYNRGRCVENECV  300

301  CDEGFTGEDCSELICPNDCFDRGRCINGTCYCEEGFTGEDCGKPTCPHAC  350
     ||||||||||||||||||||||||||||||||||||||||||||||||||
301  CDEGFTGEDCSELICPNDCFDRGRCINGTCYCEEGFTGEDCGKPTCPHAC  350

351  HTQGRCEEGQCVCDEGFAGVDCSEKRCPADCKNRGRCVDGRCECDDGFTG  400
     |||||||||||||||||||||||||||||||||| |||||||||||||||
351  HTQGRCEEGQCVCDEGFAGVDCSEKRCPADCHNRGRCVDGRCECDDGFTG  400

401  ADCGELKCPNGCSGHGRCVNGQCVCDEGYTGEDCSQLRCPNDCHSRGRCV  450
     ||||||||||||||||||||||||||||||||||||||||||||||||||
401  ADCGELKCPNGCSGHGRCVNGQCVCDEGYTGEDCSQLRCPNDCHSRGRCV  450

451  EGKCVCEQGFKGYDCSDMSCPNDCHQHGRCVNGMCVCDDGYTGEDCRDRQ  500
     ||||||||||||||||||||||||||||||||||||||||||||||||||
451  EGKCVCEQGFKGYDCSDMSCPNDCHQHGRCVNGMCVCDDGYTGEDCRDRQ  500

501  CPRDCSNRGLCVDGQCVCEDGFTGPDCAELSCPNDCHGRGRCVNGQCVCH  550
     ||||||||||||||||||||||||||||||||||||||||||||||||||
501  CPRDCSNRGLCVDGQCVCEDGFTGPDCAELSCPNDCHGRGRCVNGQCVCH  550

551  EGFMGKDCKEQRCPSDCHGQGRCVDGQCICHEGFTGLDCGQHSCPSDCNN  600
     ||||| ||||||||||||||||||||||||||||||||||||||||||||
551  EGFMCKDCKEQRCPSDCHGQGRCVDGQCICHEGFTGLDCGQHSCPSDCNN  600

601  LGQCVSGRCICNEGYSGEDCSEVSPPKDLVVTEVTEETVNLAWDNEMRVT  650
     ||||||||||||||||||||||||||||||||||||||||||||||||||
601  LGQCVSGRCICNEGYSGEDCSEVSPPKDLVVTEVTEETVNLAWDNEMRVT  650

651  EYLVVYTPTHEGGLEMQFRVPGDQTSTIIQELEPGVEYFIRVFAILENKK  700
     ||||||||||||||||||||||||||||||||||||||||||||||||||
651  EYLVVYTPTHEGGLEMQFRVPGDQTSTIIQELEPGVEYFIRVFAILENKK  700

701  SIPVSARVATYLPAPEGLKFKSIKETSVEVEWDPLDIAFETWEIIFRNMN  750
     ||||||||||||||||||||||||||||||||||||||||||||||||||
701  SIPVSARVATYLPAPEGLKFKSIKETSVEVEWDPLDIAFETWEIIFRNMN  750

751  KEDEGEITKSLRRPETSYRQTGLAPGQEYEISLHIVKNNTRGPGLKRVTT  800
     ||||||||||||||||||||||||||||||||||||||||||||||||||
751  KEDEGEITKSLRRPETSYRQTGLAPGQEYEISLHIVKNNTRGPGLKRVTT  800

801  TRLDAPSQIEVKDVTDTTALITWFKPLAEIDGIELTYGIKDVPGDRTTID  850
     ||||||||||||||||||||||||||||||||||||||||||||||||||
801  TRLDAPSQIEVKDVTDTTALITWFKPLAEIDGIELTYGIKDVPGDRTTID  850

851  LTEDENQYSIGNLKPDTEYEVSLISRRGDMSSNPAKETFTTGLDAPRNLR  900
     ||||||||||||||||||||||||||||||||||||||||||||||||||
851  LTEDENQYSIGNLKPDTEYEVSLISRRGDMSSNPAKETFTTGLDAPRNLR  900

901  RVSQTDNSITLEWRNGKAAIDSYRIKYAPISGGDHAEVDVPKSQQATTKT  950
     ||||||||||||||||||||||||||||||||||||||||||||||||||
901  RVSQTDNSITLEWRNGKAAIDSYRIKYAPISGGDHAEVDVPKSQQATTKT  950

951  TLTGLRPGTEYGIGVSAVKEDKESNPATINAATELDTPKDLQVSETAETS  1000
     ||||||||||||||||||||||||||||||||||||||||||||||||||
951  TLTGLRPGTEYGIGVSAVKEDKESNPATINAATELDTPKDLQVSETAETS  1000

1001 LTLLWKTPLAKFDRYRLNYSLPTGQWVGVQLPRNTTSYVLRGLEPGQEYN  1050
     ||||||||||||||||||||||||||||||||||||||||||||||||||
1001 LTLLWKTPLAKFDRYRLNYSLPTGQWVGVQLPRNTTSYVLRGLEPGQEYN  1050

1051 VLLTAEKGRHKSKPARVKASTEQAPELENLTVTEVGWDGLRLNWTAADQA  1100
     |||||||||||||||||||||||||| |||||||||||||||||||||||
1051 VLLTAEKGRHKSKPARVKASTEQARELENLTVTEVGWDGLRLNWTAADQA  1100

1101 YEHFIIQVQEANKVEAARNLTVPGSLRAVDIPGLKAATPYTVSIYGVIQG  1150
     ||||||||||||||||||||||||||||||||||||||||||||||||||
1101 YEHFIIQVQEANKVEAARNLTVPGSLRAVDIPGLKAATPYTVSIYGVIQG  1150

1151 YRTPVLSAEASTGETPNLGEVVVAEVGWDALKLNWTAPEGAYEYFFIQVQ  1200
     ||||||||||||||||||||||||||||||||||||||||||||||||||
1151 YRTPVLSAEASTGETPNLGEVVVAEVGWDALKLNWTAPEGAYEYFFIQVQ  1200
```

```
-continued

1201 EADTVEAAQNLTVPGGLRSTDLPGLKAATHYTITIRGVTQDFSTTPLSVE 1250
     ||||||||||||||||||||||||||||||||||||||||||||||||||
1201 EADTVEAAQNLTVPGGLRSTDLPGLKAATHYTITIRGVTQDFSTTPLSVE 1250

1251 VLTEEVPDMGNLTVTEVSWDALRLNWTTPDGTYDQFTIQVQEADQVEEAH 1300
     ||||||||||||||||||||||||||||||||||||||||||||||||||
1251 VLTEEVPDMGNLTVTEVSWDALRLNWTTPDGTYDQFTIQVQEADQVEEAH 1300

1301 NLTVPGSLRSMEIPGLRAGTPYTVTLHGEVRGHSTRPLAVEVVTEDLPQL 1350
     ||||||||||||||||||||||||||||||||||||||||||||||||||
1301 NLTVPGSLRSMEIPGLRAGTPYTVTLHGEVRGHSTRPLAVEVVTEDLPQL 1350

1351 GDLAVSEVGWDGLRLNWTAADNAYEHFVIQVQEVNKVEAAQNLTLPGSLR 1400
     ||||||||||||||||||||||||||||||||||||||||||||||||||
1351 GDLAVSEVGWDGLRLNWTAADNAYEHFVIQVQEVNKVEAAQNLTLPGSLR 1400

1401 AVDIPGLEAATPYRVSIYGVIRGYRTPVLSAEASTAKEPEIGNLNVSDIT 1450
     ||||||||||||||||||||||||||||||||||||||||||||||||||
1401 AVDIPGLEAATPYRVSIYGVIRGYRTPVLSAEASTAKEPEIGNLNVSDIT 1450

1451 PESFNLSWMATDGIFETFTIEIIDSNRLLETVEYNISGAERTAHISGLPP 1500
     ||||||||||||||||||||||||||||||||||||||||||||||||||
1451 PESFNLSWMATDGIFETFTIEIIDSNRLLETVEYNISGAERTAHISGLPP 1500

1501 STDFIVYLSGLAPSIRTKTISATATTEALPLLENLTISDINPYGFTVSWN 1550
     ||||||||||||||||||||||||||||||||||||||||||||||||||
1501 STDFIVYLSGLAPSIRTKTISATATTEALPLLENLTISDINPYGFTVSWN 1550

1551 ASENAFDSFLVTVVDSGKLLDPQEFTLSGTQRKLELRGLITGIGYEVMVS 1600
     ||||||||||||||||||||||||||||||||||||||||||||||||||
1551 ASENAFDSFLVTVVDSGKLLDPQEFTLSGTQRKLELRGLITGIGYEVMVS 1600

1601 GFTQGHQTKPLRAEIVTEAEPEVDNLLVSDATPDGFRLSWTADEGVFDNF 1650
     ||||||||||||||||||||||||||||||||||||||||||||||||||
1601 GFTQGHQTKPLRAEIVTEAEPEVDNLLVSDATPDGFRLSWTADEGVFDNF 1650

1651 VLKIRDTKKQSEPLEITLLAPERTRDLTGLREATEYEIELYGISKGRRSQ 1700
     ||||||||||||||||||||||||||||||||||||||||||||||||||
1651 VLKIRDTKKQSEPLEITLLAPERTRDLTGLREATEYEIELYGISKGRRSQ 1700

1701 TVSAIATTAMGSPKEVIFSDITENSATVSWRAPTAQVESFRITYVPITGG 1750
     ||||||||||||||||||||||||||||||||||||||||||||||||||
1701 TVSAIATTAMGSPKEVIFSDITENSATVSWRAPTAQVESFRITYVPITGG 1750

1751 TPSMVTVDGTKTQTRLVKLIPGVEYLVSIIAMKGFEESEPVSGSFTTALD 1800
     ||||||||||||||||||||||||||||||||||||||||||||||||||
1751 TPSMVTVDGTKTQTRLVKLIPGVEYLVSIIAMKGFEESEPVSGSFTTALD 1800

1801 GPSGLVTANITDSEALARWQPAIATVDSYVISYTGEKVPEITRRVSGNTV 1850
     ||||||||||||||||||||||||||||||||||||||||||||||||||
1801 GPSGLVTANITDSEALARWQPAIATVDSYVISYTGEKVPEITRTVSGNTV 1850

1851 EYALTDLEPATEYTLRIFAEKGPQKSSTITAKFTTDLDSPRDLTATEVQS 1900
     ||||||||||||||||||||||||||||||||||||||||||||||||||
1851 EYALTDLEPATEYTLRIFAEKGPQKSSTITAKFTTDLDSPRDLTATEVQS 1900

1901 ETALLTWRPPRASVTGYLLVYESVDGTVKEVIVGPDTTSYSLADLSPSTH 1950
     ||||||||||||||||||||||||||||||||||||||||||||||||||
1901 ETALLTWRPPRASVTGYLLVYESVDGTVKEVIVGPDTTSYSLADLSPSTH 1950

1951 YTAKIQALNGPLRSNMIQTIFTTIGLLYPFPKDCSQAMLNGDTTSGLYTI 2000
     ||||||||||||||||||||||||||||||||||||||||||||||||||
1951 YTAKIQALNGPLRSNMIQTIFTTIGLLYPFPKDCSQAMLNGDTTSGLYTI 2000

2001 YLNGDKAQALEVFCDMTSDGGGWIVFLRRKNGRENFYQNWKAYAAGFGDR 2050
     ||||||||||||||||||||||||||||||||||||||||||||||||||
2001 YLNGDKAQALEVFCDMTSDGGGWIVFLRRKNGRENFYQNWKAYAAGFGDR 2050

2051 REEFWLG 2057
     |||||||
2051 REEFWLG 2057
```

Sequence name: TENA_HUMAN_V1

Sequence documentation:

Alignment of: HUMTEN_PEA_1_P26 (SEQ ID NO: 946) x TENA_HUMAN_V1 . . .

Alignment segment 1/1:
  Quality: 16903.00

Escore: 0
  Matching length: 1708 Total length: 1708

Matching Percent Similarity: 100.00 Matching Percent Identity: 100.00

Total Percent Similarity: 100.00 Total Percent Identity: 100.00

Gaps: 0

Alignment:

```
  1 MGAMTQLLAGVFLAFLALATEGGVLKKVIRHKRQSGVNATLPEENQPVVF  50
    ||||||||||||||||||||||||||||||||||||||||||||||||||
  1 MGAMTQLLAGVFLAFLALATEGGVLKKVIRHKRQSGVNATLPEENQPVVF  50

51 NHVYNIKLPVGSQCSVDLESASGEKDLAPPSEPSESFQEHTVDGENQIVF 100
    ||||||||||||||||||||||||||||||||||||||||||||||||||
 51 NHVYNIKLPVGSQCSVDLESASGEKDLAPPSEPSESFQEHTVDGENQIVF 100

101 THRINIPRRACGCAAAPDVKELLSRLEELENLVSSLREQCTAGAGCCLQP 150
    ||||||||||||||||||||||||||||||||||||||||||||||||||
101 THRINIPRRACGCAAAPDVKELLSRLEELENLVSSLREQCTAGAGCCLQP 150

151 ATGRLDTRPFCSGRGNFSTEGCGCVCEPGWKGPNCSEPECPGNCHLRGRC 200
    ||||||||||||||||||||||||||||||||||||||||||||||||||
151 ATGRLDTRPFCSGRGNFSTEGCGCVCEPGWKGPNCSEPECPGNCHLRGRC 200

201 IDGQCICDDGFTGEDCSQLACPSDCNDQGKCVNGVCICFEGYAGADCSRE 250
    ||||||||||||||||||||||||||||||||||||||||||||||||||
201 IDGQCICDDGFTGEDCSQLACPSDCNDQGKCVNGVCICFEGYAGADCSRE 250

251 ICPVPCSEEHGTCVDGLCVCHDGFAGDDCNKPLCLNNCYNRGRCVENECV 300
    ||||||||||||||||||||||||||||||||||||||||||||||||||
251 ICPVPCSEEHGTCVDGLCVCHDGFAGDDCNKPLCLNNCYNRGRCVENECV 300

301 CDEGFTGEDCSELICPNDCFDRGRCINGTCYCEEGFTGEDCGKPTCPHAC 350
    ||||||||||||||||||||||||||||||||||||||||||||||||||
301 CDEGFTGEDCSELICPNDCFDRGRCINGTCYCEEGFTGEDCGKPTCPHAC 350

351 HTQGRCEEGQCVCDEGFAGVDCSEKRCPADCKNRGRCVDGRCECDDGFTG 400
    ||||||||||||||||||||||||||||||||||||||||||||||||||
351 HTQGRCEEGQCVCDEGFAGVDCSEKRCPADCHNRGRCVDGRCECDDGFTG 400

401 ADCGELKCPNGCSGHGRCVNGQCVCDEGYTGEDCSQLRCPNDCHSRGRCV 450
    ||||||||||||||||||||||||||||||||||||||||||||||||||
401 ADCGELKCPNGCSGHGRCVNGQCVCDEGYTGEDCSQLRCPNDCHSRGRCV 450

451 EGKCVCEQGFKGYDCSDMSCPNDCHQHGRCVNGMCVCDDGYTGEDCRDRQ 500
    ||||||||||||||||||||||||||||||||||||||||||||||||||
451 EGKCVCEQGFKGYDCSDMSCPNDCHQHGRCVNGMCVCDDGYTGEDCRDRQ 500

501 CPRDCSNRGLCVDGQCVCEDGFTGPDCAELSCPNDCHGRGRCVNGQCVCH 550
    ||||||||||||||||||||||||||||||||||||||||||||||||||
501 CPRDCSNRGLCVDGQCVCEDGFTGPDCAELSCPNDCHGRGRCVNGQCVCH 550

551 EGFMGKDCKEQRCPSDCHGQGRCVDGQCICHEGFTGLDCGQHSCPSDCNN 600
    ||||||||||||||||||||||||||||||||||||||||||||||||||
551 EGFMCKDCKEQRCPSDCHGQGRCVDGQCICHEGFTGLDCGQHSCPSDCNN 600

601 LGQCVSGRCICNEGYSGEDCSEVSPPKDLVVTEVTEETVNLAWDNEMRVT 650
    ||||||||||||||||||||||||||||||||||||||||||||||||||
601 LGQCVSGRCICNEGYSGEDCSEVSPPKDLVVTEVTEETVNLAWDNEMRVT 650

651 EYLVVYTPTHEGGLEMQFRVPGDQTSTIIQELEPGVEYFIRVFAILENKK 700
    ||||||||||||||||||||||||||||||||||||||||||||||||||
651 EYLVVYTPTHEGGLEMQFRVPGDQTSTIIQELEPGVEYFIRVFAILENKK 700

701 SIPVSARVATYLPAPEGLKFKSIKETSVEVEWDPLDIAFETWEIIFRNMN 750
    ||||||||||||||||||||||||||||||||||||||||||||||||||
701 SIPVSARVATYLPAPEGLKFKSIKETSVEVEWDPLDIAFETWEIIFRNMN 750

751 KEDEGEITKSLRRPETSYRQTGLAPGQEYEISLHIVKNNTRGPGLKRVTT 800
    ||||||||||||||||||||||||||||||||||||||||||||||||||
751 KEDEGEITKSLRRPETSYRQTGLAPGQEYEISLHIVKNNTRGPGLKRVTT 800

801 TRLDAPSQIEVKDVTDTTALITWFKPLAEIDGIELTYGIKDVPGDRTTID 850
    ||||||||||||||||||||||||||||||||||||||||||||||||||
801 TRLDAPSQIEVKDVTDTTALITWFKPLAEIDGIELTYGIKDVPGDRTTID 850
```

-continued

```
 851  LTEDENQYSIGNLKPDTEYEVSLISRRGDMSSNPAKETFTTGLDAPRNLR   900
      ||||||||||||||||||||||||||||||||||||||||||||||||||
 851  LTEDENQYSIGNLKPDTEYEVSLISRRGDMSSNPAKETFTTGLDAPRNLR   900

901  RVSQTDNSITLEWRNGKAAIDSYRIKYAPISGGDHAEVDVPKSQQATTKT   950
      ||||||||||||||||||||||||||||||||||||||||||||||||||
 901  RVSQTDNSITLEWRNGKAAIDSYRIKYAPISGGDHAEVDVPKSQQATTKT   950

951  TLTGLRPGTEYGIGVSAVKEDKESNPATINAATELDTPKDLQVSETAETS  1000
      ||||||||||||||||||||||||||||||||||||||||||||||||||
 951  TLTGLRPGTEYGIGVSAVKEDKESNPATINAATELDTPKDLQVSETAETS  1000

1001  LTLLWKTPLAKFDRYRLNYSLPTGQWVGVQLPRNTTSYVLRGLEPGQEYN  1050
      ||||||||||||||||||||||||||||||||||||||||||||||||||
1001  LTLLWKTPLAKFDRYRLNYSLPTGQWVGVQLPRNTTSYVLRGLEPGQEYN  1050

1051  VLLTAEKGRHKSKPARVKASTEQAPELENLTVTEVGWDGLRLNWTAADQA  1100
      |||||||||||||||||||||||||| |||||||||||||||||||||||
1051  VLLTAEKGRHKSKPARVKASTEQARELENLTVTEVGWDGLRLNWTAADQA  1100

1101  YEHFIIQVQEANKVEAARNLTVPGSLRAVDIPGLKAATPYTVSIYGVIQG  1150
      ||||||||||||||||||||||||||||||||||||||||||||||||||
1101  YEHFIIQVQEANKVEAARNLTVPGSLRAVDIPGLKAATPYTVSIYGVIQG  1150

1151  YRTPVLSAEASTGETPNLGEVVVAEVGWDALKLNWTAPEGAYEYFFIQVQ  1200
      ||||||||||||||||||||||||||||||||||||||||||||||||||
1151  YRTPVLSAEASTGETPNLGEVVVAEVGWDALKLNWTAPEGAYEYFFIQVQ  1200

1201  EADTVEAAQNLTVPGGLRSTDLPGLKAATHYTITIRGVTQDFSTTPLSVE  1250
      ||||||||||||||||||||||||||||||||||||||||||||||||||
1201  EADTVEAAQNLTVPGGLRSTDLPGLKAATHYTITIRGVTQDFSTTPLSVE  1250

1251  VLTEEVPDMGNLTVTEVSWDALRLNWTTPDGTYDQFTIQVQEADQVEEAH  1300
      ||||||||||||||||||||||||||||||||||||||||||||||||||
1251  VLTEEVPDMGNLTVTEVSWDALRLNWTTPDGTYDQFTIQVQEADQVEEAH  1300

1301  NLTVPGSLRSMEIPGLRAGTPYTVTLHGEVRGHSTRPLAVEVVTEDLPQL  1350
      ||||||||||||||||||||||||||||||||||||||||||||||||||
1301  NLTVPGSLRSMEIPGLRAGTPYTVTLHGEVRGHSTRPLAVEVVTEDLPQL  1350

1351  GDLAVSEVGWDGLRLNWTAADNAYEHFVIQVQEVNKVEAAQNLTLPGSLR  1400
      ||||||||||||||||||||||||||||||||||||||||||||||||||
1351  GDLAVSEVGWDGLRLNWTAADNAYEHFVIQVQEVNKVEAAQNLTLPGSLR  1400

1401  AVDIPGLEAATPYRVSIYGVIRGYRTPVLSAEASTAKEPEIGNLNVSDIT  1450
      ||||||||||||||||||||||||||||||||||||||||||||||||||
1401  AVDIPGLEAATPYRVSIYGVIRGYRTPVLSAEASTAKEPEIGNLNVSDIT  1450

1451  PESFNLSWMATDGIFETFTIEIIDSNRLLETVEYNISGAERTAHISGLPP  1500
      ||||||||||||||||||||||||||||||||||||||||||||||||||
1451  PESFNLSWMATDGIFETFTIEIIDSNRLLETVEYNISGAERTAHISGLPP  1500

1501  STDFIVYLSGLAPSIRTKTISATATTEALPLLENLTISDINPYGFTVSWN  1550
      ||||||||||||||||||||||||||||||||||||||||||||||||||
1501  STDFIVYLSGLAPSIRTKTISATATTEALPLLENLTISDINPYGFTVSWN  1550

1551  ASENAFDSFLVTVVDSGKLLDPQEFTLSGTQRKLELRGLITGIGYEVMVS  1600
      ||||||||||||||||||||||||||||||||||||||||||||||||||
1551  ASENAFDSFLVTVVDSGKLLDPQEFTLSGTQRKLELRGLITGIGYEVMVS  1600

1601  GFTQGHQTKPLRAEIVTEAEPEVDNLLVSDATPDGFRLSWTADEGVFDNF  1650
      ||||||||||||||||||||||||||||||||||||||||||||||||||
1601  GFTQGHQTKPLRAEIVTEAEPEVDNLLVSDATPDGFRLSWTADEGVFDNF  1650

1651  VLKIRDTKKQSEPLEITLLAPERTRDLTGLREATEYEIELYGISKGRRSQ  1700
      ||||||||||||||||||||||||||||||||||||||||||||||||||
1651  VLKIRDTKKQSEPLEITLLAPERTRDLTGLREATEYEIELYGISKGRRSQ  1700

1701  TVSAIATT  1708
      ||||||||
1701  TVSAIATT  1708
```

Sequence name: TENA_HUMAN_V1

Sequence documentation:

Alignment of: HUMTEN_PEA_1_P27 (SEQ ID NO: 947) x TENA_HUMAN_V1 . . .

Alignment segment 1/1:

Quality: 13445.00

Escore: 0

Matching length: 1344 Total length: 1344

Matching Percent Similarity: 100.00 Matching Percent

Identity: 100.00    Gaps: 0
Total Percent Similarity: 100.00 Total Percent

Identity: 100.00    Alignment:

```
  1  MGAMTQLLAGVFLAFLALATEGGVLKKVIRHKRQSGVNATLPEENQPVVF   50
     ||||||||||||||||||||||||||||||||||||||||||||||||||
  1  MGAMTQLLAGVFLAFLALATEGGVLKKVIRHKRQSGVNATLPEENQPVVF   50

51  NHVYNIKLPVGSQCSVDLESASGEKDLAPPSEPSESFQEHTVDGENQIVF  100
     ||||||||||||||||||||||||||||||||||||||||||||||||||
 51  NHVYNIKLPVGSQCSVDLESASGEKDLAPPSEPSESFQEHTVDGENQIVF  100

101  THRINIPRRACGCAAAPDVKELLSRLEELENLVSSLREQCTAGAGCCLQP  150
     ||||||||||||||||||||||||||||||||||||||||||||||||||
101  THRINIPRRACGCAAAPDVKELLSRLEELENLVSSLREQCTAGAGCCLQP  150

151  ATGRLDTRPFCSGRGNFSTEGCGCVCEPGWKGPNCSEPECPGNCHLRGRC  200
     ||||||||||||||||||||||||||||||||||||||||||||||||||
151  ATGRLDTRPFCSGRGNFSTEGCGCVCEPGWKGPNCSEPECPGNCHLRGRC  200

201  IDGQCICDDGFTGEDCSQLACPSDCNDQGKCVNGVCICFEGYAGADCSRE  250
     ||||||||||||||||||||||||||||||||||||||||||||||||||
201  IDGQCICDDGFTGEDCSQLACPSDCNDQGKCVNGVCICFEGYAGADCSRE  250

251  ICPVPCSEEHGTCVDGLCVCHDGFAGDDCNKPLCLNNCYNRGRCVENECV  300
     ||||||||||||||||||||||||||||||||||||||||||||||||||
251  ICPVPCSEEHGTCVDGLCVCHDGFAGDDCNKPLCLNNCYNRGRCVENECV  300

301  CDEGFTGEDCSELICPNDCFDRGRCINGTCYCEEGFTGEDCGKPTCPHAC  350
     ||||||||||||||||||||||||||||||||||||||||||||||||||
301  CDEGFTGEDCSELICPNDCFDRGRCINGTCYCEEGFTGEDCGKPTCPHAC  350

351  HTQGRCEEGQCVCDEGFAGVDCSEKRCPADCKNRGRCVDGRCECDDGFTG  400
     ||||||||||||||||||||||||||||||||||||||||||||||||||
351  HTQGRCEEGQCVCDEGFAGVDCSEKRCPADCHNRGRCVDGRCECDDGFTG  400

401  ADCGELKCPNGCSGHGRCVNGQCVCDEGYTGEDCSQLRCPNDCHSRGRCV  450
     ||||||||||||||||||||||||||||||||||||||||||||||||||
401  ADCGELKCPNGCSGHGRCVNGQCVCDEGYTGEDCSQLRCPNDCHSRGRCV  450

451  EGKCVCEQGFKGYDCSDMSCPNDCHQHGRCVNGMCVCDDGYTGEDCRDRQ  500
     ||||||||||||||||||||||||||||||||||||||||||||||||||
451  EGKCVCEQGFKGYDCSDMSCPNDCHQHGRCVNGMCVCDDGYTGEDCRDRQ  500

501  CPRDCSNRGLCVDGQCVCEDGFTGPDCAELSCPNDCHGRGRCVNGQCVCH  550
     ||||||||||||||||||||||||||||||||||||||||||||||||||
501  CPRDCSNRGLCVDGQCVCEDGFTGPDCAELSCPNDCHGRGRCVNGQCVCH  550

551  EGFMGKDCKEQRCPSDCHGQGRCVDGQCICHEGFTGLDCGQHSCPSDCNN  600
     ||||||||||||||||||||||||||||||||||||||||||||||||||
551  EGFMCKDCKEQRCPSDCHGQGRCVDGQCICHEGFTGLDCGQHSCPSDCNN  600

601  LGQCVSGRCICNEGYSGEDCSEVSPPKDLVVTEVTEETVNLAWDNEMRVT  650
     ||||||||||||||||||||||||||||||||||||||||||||||||||
601  LGQCVSGRCICNEGYSGEDCSEVSPPKDLVVTEVTEETVNLAWDNEMRVT  650

651  EYLVVYTPTHEGGLEMQFRVPGDQTSTIIQELEPGVEYFIRVFAILENKK  700
     ||||||||||||||||||||||||||||||||||||||||||||||||||
651  EYLVVYTPTHEGGLEMQFRVPGDQTSTIIQELEPGVEYFIRVFAILENKK  700

701  SIPVSARVATYLPAPEGLKFKSIKETSVEVEWDPLDIAFETWEIIFRNMN  750
     ||||||||||||||||||||||||||||||||||||||||||||||||||
701  SIPVSARVATYLPAPEGLKFKSIKETSVEVEWDPLDIAFETWEIIFRNMN  750

751  KEDEGEITKSLRRPETSYRQTGLAPGQEYEISLHIVKNNTRGPGLKRVTT  800
     ||||||||||||||||||||||||||||||||||||||||||||||||||
751  KEDEGEITKSLRRPETSYRQTGLAPGQEYEISLHIVKNNTRGPGLKRVTT  800

801  TRLDAPSQIEVKDVTDTTALITWFKPLAEIDGIELTYGIKDVPGDRTTID  850
     ||||||||||||||||||||||||||||||||||||||||||||||||||
801  TRLDAPSQIEVKDVTDTTALITWFKPLAEIDGIELTYGIKDVPGDRTTID  850

851  LTEDENQYSIGNLKPDTEYEVSLISRRGDMSSNPAKETFTTGLDAPRNLR  900
     ||||||||||||||||||||||||||||||||||||||||||||||||||
851  LTEDENQYSIGNLKPDTEYEVSLISRRGDMSSNPAKETFTTGLDAPRNLR  900

901  RVSQTDNSITLEWRNGKAAIDSYRIKYAPISGGDHAEVDVPKSQQATTKT  950
     ||||||||||||||||||||||||||||||||||||||||||||||||||
901  RVSQTDNSITLEWRNGKAAIDSYRIKYAPISGGDHAEVDVPKSQQATTKT  950
```

```
 951  TLTGLRPGTEYGIGVSAVKEDKESNPATINAATELDTPKDLQVSETAETS  1000
      |||||||||||||||||||||||||||||||||||||||||||||||||
 951  TLTGLRPGTEYGIGVSAVKEDKESNPATINAATELDTPKDLQVSETAETS  1000

1001  LTLLWKTPLAKFDRYRLNYSLPTGQWVGVQLPRNTTSYVLRGLEPGQEYN  1050
      |||||||||||||||||||||||||||||||||||||||||||||||||
1001  LTLLWKTPLAKFDRYRLNYSLPTGQWVGVQLPRNTTSYVLRGLEPGQEYN  1050

1051  VLLTAEKGRHKSKPARVKASTEQAPELENLTVTEVGWDGLRLNWTAADQA  1100
      |||||||||||||||||||||||||||||||||||||||||||||||||
1051  VLLTAEKGRHKSKPARVKASTEQARELENLTVTEVGWDGLRLNWTAADQA  1100

1101  YEHFIIQVQEANKVEAARNLTVPGSLRAVDIPGLKAATPYTVSIYGVIQG  1150
      |||||||||||||||||||||||||||||||||||||||||||||||||
1101  YEHFIIQVQEANKVEAARNLTVPGSLRAVDIPGLKAATPYTVSIYGVIQG  1150

1151  YRTPVLSAEASTGETPNLGEVVVAEVGWDALKLNWTAPEGAYEYFFIQVQ  1200
      |||||||||||||||||||||||||||||||||||||||||||||||||
1151  YRTPVLSAEASTGETPNLGEVVVAEVGWDALKLNWTAPEGAYEYFFIQVQ  1200

1201  EADTVEAAQNLTVPGGLRSTDLPGLKAATHYTITIRGVTQDFSTTPLSVE  1250
      |||||||||||||||||||||||||||||||||||||||||||||||||
1201  EADTVEAAQNLTVPGGLRSTDLPGLKAATHYTITIRGVTQDFSTTPLSVE  1250

1251  VLTEEVPDMGNLTVTEVSWDALRLNWTTPDGTYDQFTIQVQEADQVEEAH  1300
      |||||||||||||||||||||||||||||||||||||||||||||||||
1251  VLTEEVPDMGNLTVTEVSWDALRLNWTTPDGTYDQFTIQVQEADQVEEAH  1300

1301  NLTVPGSLRSMEIPGLRAGTPYTVTLHGEVRGHSTRPLAVEVVT       1344
      ||||||||||||||||||||||||||||||||||||||||||||
1301  NLTVPGSLRSMEIPGLRAGTPYTVTLHGEVRGHSTRPLAVEVVT       1344
```

Sequence name: TENA_HUMAN_V1

Sequence documentation:

Alignment of: HUMTEN_PEA__1_P28 (SEQ ID NO: 948) x TENA_HUMAN_V1 . . .

Alignment segment 1/1:
  Quality: 12559.00

Escore: 0
  Matching length: 1253 Total length: 1253

Matching Percent Similarity: 100.00 Matching Percent Identity: 100.00

Total Percent Similarity: 100.00 Total Percent Identity: 100.00

Gaps: 0

Alignment:

```
   1  MGAMTQLLAGVFLAFLALATEGGVLKKVIRHKRQSGVNATLPEENQPVVF   50
      |||||||||||||||||||||||||||||||||||||||||||||||||
   1  MGAMTQLLAGVFLAFLALATEGGVLKKVIRHKRQSGVNATLPEENQPVVF   50

51  NHVYNIKLPVGSQCSVDLESASGEKDLAPPSEPSESFQEHTVDGENQIVF  100
      |||||||||||||||||||||||||||||||||||||||||||||||||
  51  NHVYNIKLPVGSQCSVDLESASGEKDLAPPSEPSESFQEHTVDGENQIVF  100

101  THRINIPRRACGCAAAPDVKELLSRLEELENLVSSLREQCTAGAGCCLQP  150
      |||||||||||||||||||||||||||||||||||||||||||||||||
 101  THRINIPRRACGCAAAPDVKELLSRLEELENLVSSLREQCTAGAGCCLQP  150

151  ATGRLDTRPFCSGRGNFSTEGCGCVCEPGWKGPNCSEPECPGNCHLRGRC  200
      |||||||||||||||||||||||||||||||||||||||||||||||||
 151  ATGRLDTRPFCSGRGNFSTEGCGCVCEPGWKGPNCSEPECPGNCHLRGRC  200

201  IDGQCICDDGFTGEDCSQLACPSDCNDQGKCVNGVCICFEGYAGADCSRE  250
      |||||||||||||||||||||||||||||||||||||||||||||||||
 201  IDGQCICDDGFTGEDCSQLACPSDCNDQGKCVNGVCICFEGYAGADCSRE  250

251  ICPVPCSEEHGTCVDGLCVCHDGFAGDDCNKPLCLNNCYNRGRCVENECV  300
      |||||||||||||||||||||||||||||||||||||||||||||||||
 251  ICPVPCSEEHGTCVDGLCVCHDGFAGDDCNKPLCLNNCYNRGRCVENECV  300

301  CDEGFTGEDCSELICPNDCFDRGRCINGTCYCEEGFTGEDCGKPTCPHAC  350
      |||||||||||||||||||||||||||||||||||||||||||||||||
 301  CDEGFTGEDCSELICPNDCFDRGRCINGTCYCEEGFTGEDCGKPTCPHAC  350
```

```
351  HTQGRCEEGQCVCDEGFAGVDCSEKRCPADCKNRGRCVDGRCECDDGFTG  400
     ||||||||||||||||||||||||||||||||||||||||||||||||||
351  HTQGRCEEGQCVCDEGFAGVDCSEKRCPADCHNRGRCVDGRCECDDGFTG  400

401  ADCGELKCPNGCSHGRCVNGQCVCDEGYTGEDCSQLRCPNDCHSRGRCV   450
     ||||||||||||||||||||||||||||||||||||||||||||||||
401  ADCGELKCPNGCSHGRCVNGQCVCDEGYTGEDCSQLRCPNDCHSRGRCV   450

451  EGKCVCEQGFKGYDCSDMSCPNDCHQHGRCVNGMCVCDDGYTGEDCRDRQ  500
     ||||||||||||||||||||||||||||||||||||||||||||||||||
451  EGKCVCEQGFKGYDCSDMSCPNDCHQHGRCVNGMCVCDDGYTGEDCRDRQ  500

501  CPRDCSNRGLCVDGQCVCEDGFTGPDCAELSCPNDCHGRGRCVNGQCVCH  550
     ||||||||||||||||||||||||||||||||||||||||||||||||||
501  CPRDCSNRGLCVDGQCVCEDGFTGPDCAELSCPNDCHGRGRCVNGQCVCH  550

551  EGFMGKDCKEQRCPSDCHGQGRCVDGQCICHEGFTGLDCGQHSCPSDCNN  600
     |||| |||||||||||||||||||||||||||||||||||||||||||||
551  EGFMCKDCKEQRCPSDCHGQGRCVDGQCICHEGFTGLDCGQHSCPSDCNN  600

601  LGQCVSGRCICNEGYSGEDCSEVSPPKDLVVTEVTEETVNLAWDNEMRVT  650
     ||||||||||||||||||||||||||||||||||||||||||||||||||
601  LGQCVSGRCICNEGYSGEDCSEVSPPKDLVVTEVTEETVNLAWDNEMRVT  650

651  EYLVVYTPTHEGGLEMQFRVPGDQTSTIIQELEPGVEYFIRVFAILENKK  700
     ||||||||||||||||||||||||||||||||||||||||||||||||||
651  EYLVVYTPTHEGGLEMQFRVPGDQTSTIIQELEPGVEYFIRVFAILENKK  700

701  SIPVSARVATYLPAPEGLKFKSIKETSVEVEWDPLDIAFETWEIIFRNMN  750
     ||||||||||||||||||||||||||||||||||||||||||||||||||
701  SIPVSARVATYLPAPEGLKFKSIKETSVEVEWDPLDIAFETWEIIFRNMN  750

751  KEDEGEITKSLRRPETSYRQTGLAPGQEYEISLHIVKNNTRGPGLKRVTT  800
     ||||||||||||||||||||||||||||||||||||||||||||||||||
751  KEDEGEITKSLRRPETSYRQTGLAPGQEYEISLHIVKNNTRGPGLKRVTT  800

801  TRLDAPSQIEVKDVTDTTALITWFKPLAEIDGIELTYGIKDVPGDRTTID  850
     ||||||||||||||||||||||||||||||||||||||||||||||||||
801  TRLDAPSQIEVKDVTDTTALITWFKPLAEIDGIELTYGIKDVPGDRTTID  850

851  LTEDENQYSIGNLKPDTEYEVSLISRRGDMSSNPAKETFTTGLDAPRNLR  900
     ||||||||||||||||||||||||||||||||||||||||||||||||||
851  LTEDENQYSIGNLKPDTEYEVSLISRRGDMSSNPAKETFTTGLDAPRNLR  900

901  RVSQTDNSITLEWRNGKAAIDSYRIKYAPISGGDHAEVDVPKSQQATTKT  950
     ||||||||||||||||||||||||||||||||||||||||||||||||||
901  RVSQTDNSITLEWRNGKAAIDSYRIKYAPISGGDHAEVDVPKSQQATTKT  950

951  TLTGLRPGTEYGIGVSAVKEDKESNPATINAATELDTPKDLQVSETAETS  1000
     ||||||||||||||||||||||||||||||||||||||||||||||||||
951  TLTGLRPGTEYGIGVSAVKEDKESNPATINAATELDTPKDLQVSETAETS  1000

1001 LTLLWKTPLAKFDRYRLNYSLPTGQWVGVQLPRNTTSYVLRGLEPGQEYN  1050
     ||||||||||||||||||||||||||||||||||||||||||||||||||
1001 LTLLWKTPLAKFDRYRLNYSLPTGQWVGVQLPRNTTSYVLRGLEPGQEYN  1050

1051 VLLTAEKGRHKSKPARVKASTEQAPELENLTVTEVGWDGLRLNWTAADQA  1100
     |||||||||||||||||||||||| |||||||||||||||||||||||||
1051 VLLTAEKGRHKSKPARVKASTEQARELENLTVTEVGWDGLRLNWTAADQA  1100

1101 YEHFIIQVQEANKVEAARNLTVPGSLRAVDIPGLKAATPYTVSIYGVIQG  1150
     ||||||||||||||||||||||||||||||||||||||||||||||||||
1101 YEHFIIQVQEANKVEAARNLTVPGSLRAVDIPGLKAATPYTVSIYGVIQG  1150

1151 YRTPVLSAEASTGETPNLGEVVVAEVGWDALKLNWTAPEGAYEYFFIQVQ  1200
     ||||||||||||||||||||||||||||||||||||||||||||||||||
1151 YRTPVLSAEASTGETPNLGEVVVAEVGWDALKLNWTAPEGAYEYFFIQVQ  1200

1201 EADTVEAAQNLTVPGGLRSTDLPGLKAATHYTITIRGVTQDFSTTPLSVE  1250
     ||||||||||||||||||||||||||||||||||||||||||||||||||
1201 EADTVEAAQNLTVPGGLRSTDLPGLKAATHYTITIRGVTQDFSTTPLSVE  1250

1251 VLT  1253
     |||
1251 VLT  1253
```

Sequence name: TENA_HUMAN_V1

Sequence documentation:

Alignment of: HUMTEN_PEA__1_P29 (SEQ ID NO: 949) x TENA_HUMAN_V1 . . .

Alignment segment 1/1:
  Quality: 10822.00

Escore: 0
  Matching length: 1071 Total length: 1071

Matching Percent Similarity: 100.00 Matching Percent Identity: 100.00

Total Percent Similarity: 100.00 Total Percent Identity: 100.00

Gaps: 0

Alignment:

```
  1  MGAMTQLLAGVFLAFLALATEGGVLKKVIRHKRQSGVNATLPEENQPVVF   50
     ||||||||||||||||||||||||||||||||||||||||||||||||||
  1  MGAMTQLLAGVFLAFLALATEGGVLKKVIRHKRQSGVNATLPEENQPVVF   50

51  NHVYNIKLPVGSQCSVDLESASGEKDLAPPSEPSESFQEHTVDGENQIVF  100
     ||||||||||||||||||||||||||||||||||||||||||||||||||
 51  NHVYNIKLPVGSQCSVDLESASGEKDLAPPSEPSESFQEHTVDGENQIVF  100

101  THRINIPRRACGCAAAPDVKELLSRLEELENLVSSLREQCTAGAGCCLQP  150
     ||||||||||||||||||||||||||||||||||||||||||||||||||
101  THRINIPRRACGCAAAPDVKELLSRLEELENLVSSLREQCTAGAGCCLQP  150

151  ATGRLDTRPFCSGRGNFSTEGCGCVCEPGWKGPNCSEPECPGNCHLRGRC  200
     ||||||||||||||||||||||||||||||||||||||||||||||||||
151  ATGRLDTRPFCSGRGNFSTEGCGCVCEPGWKGPNCSEPECPGNCHLRGRC  200

201  IDGQCICDDGFTGEDCSQLACPSDCNDQGKCVNGVCICFEGYAGADCSRE  250
     ||||||||||||||||||||||||||||||||||||||||||||||||||
201  IDGQCICDDGFTGEDCSQLACPSDCNDQGKCVNGVCICFEGYAGADCSRE  250

251  ICPVPCSEEHGTCVDGLCVCHDGFAGDDCNKPLCLNNCYNRGRCVENECV  300
     ||||||||||||||||||||||||||||||||||||||||||||||||||
251  ICPVPCSEEHGTCVDGLCVCHDGFAGDDCNKPLCLNNCYNRGRCVENECV  300

301  CDEGFTGEDCSELICPNDCFDRGRCINGTCYCEEGFTGEDCGKPTCPHAC  350
     ||||||||||||||||||||||||||||||||||||||||||||||||||
301  CDEGFTGEDCSELICPNDCFDRGRCINGTCYCEEGFTGEDCGKPTCPHAC  350

351  HTQGRCEEGQCVCDEGFAGVDCSEKRCPADCKNRGRCVDGRCECDDGFTG  400
     ||||||||||||||||||||||||||||||||||||||||||||||||||
351  HTQGRCEEGQCVCDEGFAGVDCSEKRCPADCHNRGRCVDGRCECDDGFTG  400

401  ADCGELKCPNGCSGHGRCVNGQCVCDEGYTGEDCSQLRCPNDCHSRGRCV  450
     ||||||||||||||||||||||||||||||||||||||||||||||||||
401  ADCGELKCPNGCSGHGRCVNGQCVCDEGYTGEDCSQLRCPNDCHSRGRCV  450
```

```
451  EGKCVCEQGFKGYDCSDMSCPNDCHQHGRCVNGMCVCDDGYTGEDCRDRQ  500
     |||||||||||||||||||||||||||||||||||||||||||||||||
451  EGKCVCEQGFKGYDCSDMSCPNDCHQHGRCVNGMCVCDDGYTGEDCRDRQ  500

501  CPRDCSNRGLCVDGQCVCEDGFTGPDCAELSCPNDCHGRGRCVNGQCVCH  550
     |||||||||||||||||||||||||||||||||||||||||||||||||
501  CPRDCSNRGLCVDGQCVCEDGFTGPDCAELSCPNDCHGRGRCVNGQCVCH  550

551  EGFMGKDCKEQRCPSDCHGQGRCVDGQCICHEGFTGLDCGQHSCPSDCNN  600
     ||||| |||||||||||||||||||||||||||||||||||||||||||
551  EGFMCKDCKEQRCPSDCHGQGRCVDGQCICHEGFTGLDCGQHSCPSDCNN  600

601  LGQCVSGRCICNEGYSGEDCSEVSPPKDLVVTEVTEETVNLAWDNEMRVT  650
     |||||||||||||||||||||||||||||||||||||||||||||||||
601  LGQCVSGRCICNEGYSGEDCSEVSPPKDLVVTEVTEETVNLAWDNEMRVT  650

651  EYLVVYTPTHEGGLEMQFRVPGDQTSTIIQELEPGVEYFIRVFAILENKK  700
     |||||||||||||||||||||||||||||||||||||||||||||||||
651  EYLVVYTPTHEGGLEMQFRVPGDQTSTIIQELEPGVEYFIRVFAILENKK  700

701  SIPVSARVATYLPAPEGLKFKSIKETSVEVEWDPLDIAFETWEIIFRNMN  750
     |||||||||||||||||||||||||||||||||||||||||||||||||
701  SIPVSARVATYLPAPEGLKFKSIKETSVEVEWDPLDIAFETWEIIFRNMN  750

751  KEDEGEITKSLRRPETSYRQTGLAPGQEYEISLHIVKNNTRGPGLKRVTT  800
     |||||||||||||||||||||||||||||||||||||||||||||||||
751  KEDEGEITKSLRRPETSYRQTGLAPGQEYEISLHIVKNNTRGPGLKRVTT  800

801  TRLDAPSQIEVKDVTDTTALITWFKPLAEIDGIELTYGIKDVPGDRTTID  850
     |||||||||||||||||||||||||||||||||||||||||||||||||
801  TRLDAPSQIEVKDVTDTTALITWFKPLAEIDGIELTYGIKDVPGDRTTID  850

851  LTEDENQYSIGNLKPDTEYEVSLISRRGDMSSNPAKETFTTGLDAPRNLR  900
     |||||||||||||||||||||||||||||||||||||||||||||||||
851  LTEDENQYSIGNLKPDTEYEVSLISRRGDMSSNPAKETFTTGLDAPRNLR  900

901  RVSQTDNSITLEWRNGKAAIDSYRIKYAPISGGDHAEVDVPKSQQATTKT  950
     |||||||||||||||||||||||||||||||||||||||||||||||||
901  RVSQTDNSITLEWRNGKAAIDSYRIKYAPISGGDHAEVDVPKSQQATTKT  950

951  TLTGLRPGTEYGIGVSAVKEDKESNPATINAATELDTPKDLQVSETAETS  1000
     |||||||||||||||||||||||||||||||||||||||||||||||||
951  TLTGLRPGTEYGIGVSAVKEDKESNPATINAATELDTPKDLQVSETAETS  1000

1001 LTLLWKTPLAKFDRYRLNYSLPTGQWVGVQLPRNTTSYVLRGLEPGQEYN  1050
     |||||||||||||||||||||||||||||||||||||||||||||||||
1001 LTLLWKTPLAKFDRYRLNYSLPTGQWVGVQLPRNTTSYVLRGLEPGQEYN  1050

1051 VLLTAEKGRHKSKPARVKAST                              1071
     |||||||||||||||||||||
1051 VLLTAEKGRHKSKPARVKAST                              1071
```

Sequence name: TENA_HUMAN_V1

Sequence documentation:
Alignment of: HUMTEN_PEA_1_P30 (SEQ ID NO: 950) x TENA_HUMAN_V1 ...

Alignment segment 1/1:
  Quality: 9694.00
Escore: 0
  Matching length: 954 Total length: 954

Matching Percent Similarity: 100.00 Matching Percent Identity: 100.00

Total Percent Similarity: 100.00 Total Percent Identity: 100.00

Gaps: 0

Alignment:

```
  1 MGAMTQLLAGVFLAFLALATEGGVLKKVIRHKRQSGVNATLPEENQPVVF  50
    ||||||||||||||||||||||||||||||||||||||||||||||||||
  1 MGAMTQLLAGVFLAFLALATEGGVLKKVIRHKRQSGVNATLPEENQPVVF  50

51 NHVYNIKLPVGSQCSVDLESASGEKDLAPPSEPSESFQEHTVDGENQIVF 100
    ||||||||||||||||||||||||||||||||||||||||||||||||||
 51 NHVYNIKLPVGSQCSVDLESASGEKDLAPPSEPSESFQEHTVDGENQIVF 100

101 THRINIPRRACGCAAAPDVKELLSRLEELENLVSSLREQCTAGAGCCLQP 150
    ||||||||||||||||||||||||||||||||||||||||||||||||||
101 THRINIPRRACGCAAAPDVKELLSRLEELENLVSSLREQCTAGAGCCLQP 150

151 ATGRLDTRPFCSGRGNFSTEGCGCVCEPGWKGPNCSEPECPGNCHLRGRC 200
    ||||||||||||||||||||||||||||||||||||||||||||||||||
151 ATGRLDTRPFCSGRGNFSTEGCGCVCEPGWKGPNCSEPECPGNCHLRGRC 200

201 IDGQCICDDGFTGEDCSQLACPSDCNDQGKCVNGVCICFEGYAGADCSRE 250
    ||||||||||||||||||||||||||||||||||||||||||||||||||
201 IDGQCICDDGFTGEDCSQLACPSDCNDQGKCVNGVCICFEGYAGADCSRE 250

251 ICPVPCSEEHGTCVDGLCVCHDGFAGDDCNKPLCLNNCYNRGRCVENECV 300
    ||||||||||||||||||||||||||||||||||||||||||||||||||
251 ICPVPCSEEHGTCVDGLCVCHDGFAGDDCNKPLCLNNCYNRGRCVENECV 300

301 CDEGFTGEDCSELICPNDCFDRGRCINGTCYCEEGFTGEDCGKPTCPHAC 350
    ||||||||||||||||||||||||||||||||||||||||||||||||||
301 CDEGFTGEDCSELICPNDCGDRGRCINGTCYCEEGFTGEDCGKPTCPHAC 350

351 HTQGRCEEGQCVCDEGFAGVDCSEKRCPADCHNRGRCVDGRCECDDGFTG 400
    ||||||||||||||||||||||||||||||||||||||||||||||||||
351 HTQGRCEEGQCVCDEGFAFVDCSEKRCPADCHNRGRCVDGRCECDDGFTG 400

401 ADCGELKCPNGCSGHGRCVNGQCVCDEGYTGEDCSQLRCPNDCHSRGRCV 450
    ||||||||||||||||||||||||||||||||||||||||||||||||||
401 ADCGELKCPNGCSGHGRCVNGQCVCDEGYTGEDCSQLRCPNDCHSRGRCV 450

451 EGKCVCEQGFKGYDCSDMSCPNDCHQHGRCVNGMCVCDDGYTGEDCRDRQ 500
    ||||||||||||||||||||||||||||||||||||||||||||||||||
451 EGKCVCEQGFKGYDCSDMSCPNDCHQHGRCVNGMCVCDDGYTGEDCRDRQ 500

501 CPRDCSNRGLCVDGQCVCEDGFTGPDCAELSCPNDCHGRGRCVNGQCVCH 550
    ||||||||||||||||||||||||||||||||||||||||||||||||||
501 CPRDCSNRGLCVDGQCVCEDGFTGPDCAELSCPNDCHGRGRCVNGQCVCH 550

551 EGFMGKDCKEQRCPSDCHGQGRCVDGQCICHEGFTGLDCGQHSCPSDCNN 600
    ||||||||||||||||||||||||||||||||||||||||||||||||||
551 EGFMGKDCKEQRCPSDCHGQGRCVDGQCICHEGFTGLDCGQHSCPSDCNN 600

601 LGQCVSGRCICNEGYSGEDCSEVSPPKDLVVTEVTEETVNLAWDNEMRVT 650
    ||||||||||||||||||||||||||||||||||||||||||||||||||
601 LGQCVSGRCICNEGYSGEDCSEVSPPKDLVVTEVTEETVNLAWDNEMRVT 650

651 EYLVVYTPTHEGGLEMQFRVPGDQTSTIIQELEPGVEYFIRVFAILENKK 700
    ||||||||||||||||||||||||||||||||||||||||||||||||||
651 EYLVVYTPTHEGGLEMQFRVPGDQTSTIIQELEPGVEYFIRVFAILENKK 700

701 SIPVSARVATYLPAPEGLKFKSIKETSVEVEWDPLDIAFETWEIIFRNMN 750
    ||||||||||||||||||||||||||||||||||||||||||||||||||
701 SIPVSARVATYLPAPEGLKFKSIKETSVEVEWDPLDIAFETWEIIFRNMN 750

571 KEDEGEITKSLRRPETSYRQTGLAPGQEYEISLHIVKNNTRGPGLKRVTT 800
    ||||||||||||||||||||||||||||||||||||||||||||||||||
571 KEDEGEITKSLRRPETSYRQTGLAPGQEYEISLHIVKNNTRGPGLKRVTT 800

801 TRLDAPSQIEVKDVTDTTALITWFKPLAEIDGIELTYGIKDVPGDRTTID 850
    ||||||||||||||||||||||||||||||||||||||||||||||||||
801 TRLDAPSQIEVKDVTDTTALITWFKPLAEIDGIELTYGIKDVPGDRTTID 850

851 LTEDENQYSIGNLKPDTEYEVSLISRRGDMSSNPAKETFTTGLDAPRNLR 900
    ||||||||||||||||||||||||||||||||||||||||||||||||||
851 LTEDENQYSIGNLKPDTEYEVSLISRRGDMSSNPAKETFTTGLDAPRNLR 900

901 RVSQTDNSITLEWRNGKAAIDSYRIKYAPISGGDHAEVDVPKSQQATTKT 950
    ||||||||||||||||||||||||||||||||||||||||||||||||||
901 RVSQTDNSITLEWRNGKAAIDSYRIKYAPISGGDHAEVDVPKSQQATTKT 950

951 TLTG 954
    ||||
951 TLTG 954
```

873

Sequence name: TENA_HUMAN_V1

Sequence documentation:

Alignment of: HUMTEN_PEA__1_P31 (SEQ ID NO: 951) x TENA_HUMAN_V1 . . .

Alignment segment 1/1:

Quality: 8236.00

874

Identity: 100.00

Total Percent Similarity: 100.00 Total Percent

Identity: 100.00

Gaps: 0

Alignment:

```
  1 MGAMTQLLAGVFLAFLALATEGGVLKKVIRHKRQSGVNATLPEENQPVVF  50
    ||||||||||||||||||||||||||||||||||||||||||||||||||
  1 MGAMTQLLAGVFLAFLALATEGGVLKKVIRHKRQSGVNATLPEENQPVVF  50

51 NHVYNIKLPVGSQCSVDLESASGEKDLAPPSEPSESFQEHTVDGENQIVF 100
    ||||||||||||||||||||||||||||||||||||||||||||||||||
 51 NHVYNIKLPVGSQCSVDLESASGEKDLAPPSEPSESFQEHTVDGENQIVF 100

101 THRINIPRRACGCAAAPDVKELLSRLEELENLVSSLREQCTAGAGCCLQP 150
    ||||||||||||||||||||||||||||||||||||||||||||||||||
101 THRINIPRRACGCAAAPDVKELLSRLEELENLVSSLREQCTAGAGCCLQP 150

151 ATGRLDTRPFCSGRGNFSTEGCGCVCEPGWKGPNCSEPECPGNCHLRGRC 200
    ||||||||||||||||||||||||||||||||||||||||||||||||||
151 ATGRLDTRPFCSGRGNFSTEGCGCVCEPGWKGPNCSEPECPGNCHLRGRC 200

201 IDGQCICDDGFTGEDCSQLACPSDCNDQGKCVNGVCICFEGYAGADCSRE 250
    ||||||||||||||||||||||||||||||||||||||||||||||||||
201 IDGQCICDDGFTGEDCSQLACPSDCNDQGKCVNGVCICFEGYAGADCSRE 250

251 ICPVPCSEEHGTCVDGLCVCHDGFAGDDCNKPLCLNNCYNRGRCVENECV 300
    ||||||||||||||||||||||||||||||||||||||||||||||||||
251 ICPVPCSEEHGTCVDGLCVCHDGFAGDDCNKPLCLNNCYNRGRCVENECV 300

301 CDEGFTGEDCSELICPNDCFDRGRCINGTCYCEEGFTGEDCGKPTCPHAC 350
    ||||||||||||||||||||||||||||||||||||||||||||||||||
301 CDEGFTGEDCSELICPNDCGDRGRCINGTCYCEEGFTGEDCGKPTCPHAC 350

351 HTQGRCEEGQCVCDEGFAGVDCSEKRCPADCHNRGRCVDGRCECDDGFTG 400
    ||||||||||||||||||||||||||||||||||||||||||||||||||
351 HTQGRCEEGQCVCDEGFAFVDCSEKRCPADCHNRGRCVDGRCECDDGFTG 400

401 ADCGELKCPNGCSGHGRCVNGQCVCDEGYTGEDCSQLRCPNDCHSRGRCV 450
    ||||||||||||||||||||||||||||||||||||||||||||||||||
401 ADCGELKCPNGCSGHGRCVNGQCVCDEGYTGEDCSQLRCPNDCHSRGRCV 450

451 EGKCVCEQGFKGYDCSDMSCPNDCHQHGRCVNGMCVCDDGYTGEDCRDRQ 500
    ||||||||||||||||||||||||||||||||||||||||||||||||||
451 EGKCVCEQGFKGYDCSDMSCPNDCHQHGRCVNGMCVCDDGYTGEDCRDRQ 500

501 CPRDCSNRGLCVDGQCVCEDGFTGPDCAELSCPNDCHGRGRCVNGQCVCH 550
    ||||||||||||||||||||||||||||||||||||||||||||||||||
501 CPRDCSNRGLCVDGQCVCEDGFTGPDCAELSCPNDCHGRGRCVNGQCVCH 550

551 EGFMGKDCKEQRCPSDCHGQGRCVDGQCICHEGFTGLDCGQHSCPSDCNN 600
    ||||||||||||||||||||||||||||||||||||||||||||||||||
551 EGFMGKDCKEQRCPSDCHGQGRCVDGQCICHEGFTGLDCGQHSCPSDCNN 600

601 LGQCVSGRCICNEGYSGEDCSEVSPPKDLVVTEVTEETVNLAWDNEMRVT 650
    ||||||||||||||||||||||||||||||||||||||||||||||||||
601 LGQCVSGRCICNEGYSGEDCSEVSPPKDLVVTEVTEETVNLAWDNEMRVT 650

651 EYLVVYTPTHEGGLEMQFRVPGDQTSTIIQELEPGVEYFIRVFAILENKK 700
    ||||||||||||||||||||||||||||||||||||||||||||||||||
651 EYLVVYTPTHEGGLEMQFRVPGDQTSTIIQELEPGVEYFIRVFAILENKK 700

701 SIPVSARVATYLPAPEGLKFKSIKETSVEVEWDPLDIAFETWEIIFRNMN 750
    ||||||||||||||||||||||||||||||||||||||||||||||||||
701 SIPVSARVATYLPAPEGLKFKSIKETSVEVEWDPLDIAFETWEIIFRNMN 750

571 KEDEGEITKSLRRPETSYRQTGLAPGQEYEISLHIVKNNTRGPGLKRVTT 800
    ||||||||||||||||||||||||||||||||||||||||||||||||||
571 KEDEGEITKSLRRPETSYRQTGLAPGQEYEISLHIVKNNTRGPGLKRVTT 800

801 TR                                                802
    ||
801 TR                                                802
```

Escore: 0

Matching length: 802 Total length: 802

Matching Percent Similarity: 100.00 Matching Percent

Sequence name: TENA_HUMAN_V1

Sequence documentation:

Alignment of: HUMTEN_PEA__1_P32 (SEQ ID NO: 952) x TENA_HUMAN_V1 . . .

Alignment segment 1/1:
  Quality: 7332.00

Escore: 0
  Matching length: 710 Total
length: 710

Matching Percent Similarity: 100.00 Matching Percent

Identity: 100.00
  Total Percent Similarity: 100.00 Total Percent

Identity: 100.00
  Gaps: 0

Alignment:

```
  1 MGAMTQLLAGVFLAFLALATEGGVLKKVIRHKRQSGVNATLPEENQPVVF  50
    ||||||||||||||||||||||||||||||||||||||||||||||||||
  1 MGAMTQLLAGVFLAFLALATEGGVLKKVIRHKRQSGVNATLPEENQPVVF  50

51 NHVYNIKLPVGSQCSVDLESASGEKDLAPPSEPSESFQEHTVDGENQIVF 100
    ||||||||||||||||||||||||||||||||||||||||||||||||||
 51 NHVYNIKLPVGSQCSVDLESASGEKDLAPPSEPSESFQEHTVDGENQIVF 100

101 THRINIPRRACGCAAAPDVKELLSRLEELENLVSSLREQCTAGAGCCLQP 150
    ||||||||||||||||||||||||||||||||||||||||||||||||||
101 THRINIPRRACGCAAAPDVKELLSRLEELENLVSSLREQCTAGAGCCLQP 150

151 ATGRLDTRPFCSGRGNFSTEGCGCVCEPGWKGPNCSEPECPGNCHLRGRC 200
    ||||||||||||||||||||||||||||||||||||||||||||||||||
151 ATGRLDTRPFCSGRGNFSTEGCGCVCEPGWKGPNCSEPECPGNCHLRGRC 200

201 IDGQCICDDGFTGEDCSQLACPSDCNDQGKCVNGVCICFEGYAGADCSRE 250
    ||||||||||||||||||||||||||||||||||||||||||||||||||
201 IDGQCICDDGFTGEDCSQLACPSDCNDQGKCVNGVCICFEGYAGADCSRE 250

251 ICPVPCSEEHGTCVDGLCVCHDGFAGDDCNKPLCLNNCYNRGRCVENECV 300
    ||||||||||||||||||||||||||||||||||||||||||||||||||
251 ICPVPCSEEHGTCVDGLCVCHDGFAGDDCNKPLCLNNCYNRGRCVENECV 300

301 CDEGFTGEDCSELICPNDCFDRGRCINGTCYCEEGFTGEDCGKPTCPHAC 350
    ||||||||||||||||||||||||||||||||||||||||||||||||||
301 CDEGFTGEDCSELICPNDCGDRGRCINGTCYCEEGFTGEDCGKPTCPHAC 350

351 HTQGRCEEGQCVCDEGFAGVDCSEKRCPADCHNRGRCVDGRCECDDGFTG 400
    ||||||||||||||||||||||||||||||||||||||||||||||||||
351 HTQGRCEEGQCVCDEGFAFVDCSEKRCPADCHNRGRCVDGRCECDDGFTG 400

401 ADCGELKCPNGCSGHGRCVNGQCVCDEGYTGEDCSQLRCPNDCHSRGRCV 450
    ||||||||||||||||||||||||||||||||||||||||||||||||||
401 ADCGELKCPNGCSGHGRCVNGQCVCDEGYTGEDCSQLRCPNDCHSRGRCV 450

451 EGKCVCEQGFKGYDCSDMSCPNDCHQHGRCVNGMCVCDDGYTGEDCRDRQ 500
    ||||||||||||||||||||||||||||||||||||||||||||||||||
451 EGKCVCEQGFKGYDCSDMSCPNDCHQHGRCVNGMCVCDDGYTGEDCRDRQ 500

501 CPRDCSNRGLCVDGQCVCEDGFTGPDCAELSCPNDCHGRGRCVNGQCVCH 550
    ||||||||||||||||||||||||||||||||||||||||||||||||||
501 CPRDCSNRGLCVDGQCVCEDGFTGPDCAELSCPNDCHGRGRCVNGQCVCH 550

551 EGFMGKDCKEQRCPSDCHGQGRCVDGQCICHEGFTGLDCGQHSCPSDCNN 600
    ||||||||||||||||||||||||||||||||||||||||||||||||||
551 EGFMGKDCKEQRCPSDCHGQGRCVDGQCICHEGFTGLDCGQHSCPSDCNN 600

601 LGQCVSGRCICNEGYSGEDCSEVSPPKDLVVTEVTEETVNLAWDNEMRVT 650
    ||||||||||||||||||||||||||||||||||||||||||||||||||
601 LGQCVSGRCICNEGYSGEDCSEVSPPKDLVVTEVTEETVNLAWDNEMRVT 650

651 EYLVVYTPTHEGGLEMQFRVPGDQTSTIIQELEPGVEYFIRVFAILENKK 700
    ||||||||||||||||||||||||||||||||||||||||||||||||||
651 EYLVVYTPTHEGGLEMQFRVPGDQTSTIIQELEPGVEYFIRVFAILENKK 700

701 SIPVSARVAT                                         710
    ||||||||||
701 SIPVSARVAT                                         710
```

DESCRIPTION FOR CLUSTER HUMOSTRO

Cluster HUMOSTRO features 3 transcript(s) and 30 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| HUMOSTRO_PEA_1_PEA_1_T14 | 277 |
| HUMOSTRO_PEA_1_PEA_1_T16 | 278 |
| HUMOSTRO_PEA_1_PEA_1_T30 | 279 |

TABLE 2

Segments of interest

| Segment Name | SEQ ID NO: |
|---|---|
| HUMOSTRO_PEA_1_PEA_1_node_0 | 280 |
| HUMOSTRO_PEA_1_PEA_1_node_10 | 281 |
| HUMOSTRO_PEA_1_PEA_1_node_16 | 282 |
| HUMOSTRO_PEA_1_PEA_1_node_23 | 283 |
| HUMOSTRO_PEA_1_PEA_1_node_31 | 284 |
| HUMOSTRO_PEA_1_PEA_1_node_43 | 285 |
| HUMOSTRO_PEA_1_PEA_1_node_3 | 286 |
| HUMOSTRO_PEA_1_PEA_1_node_5 | 287 |
| HUMOSTRO_PEA_1_PEA_1_node_7 | 288 |
| HUMOSTRO_PEA_1_PEA_1_node_8 | 289 |
| HUMOSTRO_PEA_1_PEA_1_node_15 | 290 |
| HUMOSTRO_PEA_1_PEA_1_node_17 | 291 |
| HUMOSTRO_PEA_1_PEA_1_node_20 | 292 |
| HUMOSTRO_PEA_1_PEA_1_node_21 | 293 |
| HUMOSTRO_PEA_1_PEA_1_node_22 | 294 |
| HUMOSTRO_PEA_1_PEA_1_node_24 | 295 |
| HUMOSTRO_PEA_1_PEA_1_node_26 | 296 |
| HUMOSTRO_PEA_1_PEA_1_node_27 | 297 |
| HUMOSTRO_PEA_1_PEA_1_node_28 | 298 |
| HUMOSTRO_PEA_1_PEA_1_node_29 | 299 |
| HUMOSTRO_PEA_1_PEA_1_node_30 | 300 |
| HUMOSTRO_PEA_1_PEA_1_node_32 | 301 |
| HUMOSTRO_PEA_1_PEA_1_node_34 | 302 |
| HUMOSTRO_PEA_1_PEA_1_node_36 | 303 |
| HUMOSTRO_PEA_1_PEA_1_node_37 | 304 |
| HUMOSTRO_PEA_1_PEA_1_node_38 | 305 |
| HUMOSTRO_PEA_1_PEA_1_node_39 | 306 |
| HUMOSTRO_PEA_1_PEA_1_node_40 | 307 |
| HUMOSTRO_PEA_1_PEA_1_node_41 | 308 |
| HUMOSTRO_PEA_1_PEA_1_node_42 | 309 |

TABLE 3

Proteins of interest

| Protein Name | SEQ ID NO: | Corresponding Transcript(s) |
|---|---|---|
| HUMOSTRO_PEA_1_PEA_1_P21 | 311 | HUMOSTRO_PEA_1_PEA_1_T14 (SEQ ID NO: 277) |
| HUMOSTRO_PEA_1_PEA_1_P25 | 312 | HUMOSTRO_PEA_1_PEA_1_T16 (SEQ ID NO: 278) |
| HUMOSTRO_PEA_1_PEA_1_P30 | 313 | HUMOSTRO_PEA_1_PEA_1_T30 (SEQ ID NO: 279) |

These sequences are variants of the known protein Osteopontin precursor (SwissProt accession identifier OSTP_HUMAN; known also according to the synonyms Bone sialoprotein 1; Urinary stone protein; Secreted phosphoprotein 1; SPP-1; Nephropontin; Uropontin), SEQ ID NO: 310, referred to herein as the previously known protein.

Protein Osteopontin precursor is known or believed to have the following function(s): binds tightly to hydroxyapatite. Appears to form an integral part of the mineralized matrix. Probably important to cell-matrix interaction. Acts as a cytokine involved in enhancing production of interferon-gamma and interleukin-12 and reducing production of interleukin-10 and is essential in the pathway that leads to type I immunity (By similarity). The sequence for protein Osteopontin precursor is given at the end of the application, as "Osteopontin precursor amino acid sequence". Known polymorphisms for this sequence are as shown in Table 4.

TABLE 4

Amino acid mutations for Known Protein

| SNP position(s) on amino acid sequence | Comment |
|---|---|
| 301 | R -> H (in dbSNP:4660). /FTId = VAR_014717. |
| 188 | D -> H |
| 237 | T -> A |
| 275-278 | SHEF -> GNSL |

Protein Osteopontin precursor localization is believed to be Secreted.

The previously known protein also has the following indication(s) and/or potential therapeutic use(s): Regeneration, bone. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Bone formation stimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Musculoskeletal.

The following GO Annotation(s) apply to the previously known protein. The following annotation(s) were found: ossification; anti-apoptosis; inflammatory response; cell-matrix adhesion; cell-cell signaling, which are annotation(s) related to Biological Process; defense/immunity protein; cytokine; integrin ligand; protein binding; growth factor; apoptosis inhibitor, which are annotation(s) related to Molecular Function; and extracellular matrix, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster HUMOSTRO can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 38 refer to weighted expression of ESTs in each category, as "parts per million" (ratio of the expression of ESTs for a particular cluster to the expression of all ESTs in that category, according to parts per million).

Figure 38:
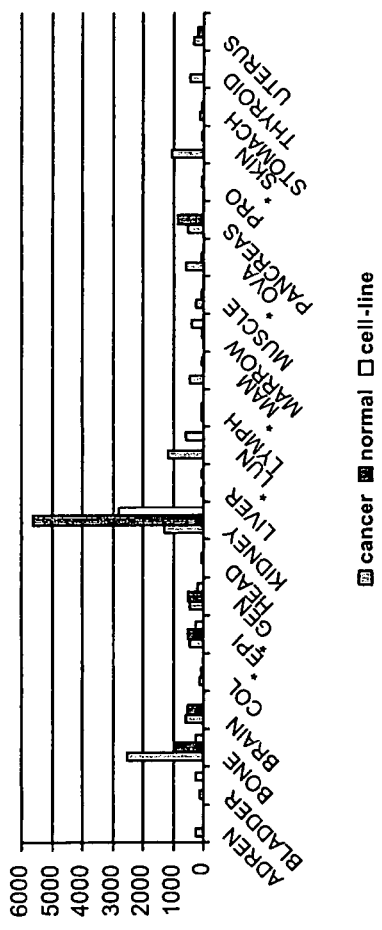
FIG. 38 shows cancer and cell-line vs. normal tissue expression.

Overall, the following results were obtained as shown with regard to the histograms in FIG. 38 and Table 5. This cluster is overexpressed (at least at a minimum level) in the following pathological conditions: epithelial malignant tumors, a mixture of malignant tumors from different tissues, lung malignant tumors, breast malignant tumors, ovarian carcinoma and skin malignancies.

TABLE 5

Normal tissue distribution

| Name of Tissue | Number |
|---|---|
| adrenal | 4 |
| bladder | 0 |
| bone | 897 |
| brain | 506 |
| colon | 69 |
| epithelial | 548 |
| general | 484 |
| head and neck | 50 |
| kidney | 5618 |
| liver | 4 |
| lung | 10 |
| lymph nodes | 75 |
| breast | 8 |
| bone marrow | 62 |
| muscle | 37 |
| ovary | 40 |
| pancreas | 845 |
| prostate | 48 |
| skin | 13 |
| stomach | 73 |
| Thyroid | 0 |
| uterus | 168 |

TABLE 6

P values and ratios for expression in cancerous tissue

| Name of Tissue | P1 | P2 | SP1 | R3 | SP2 | R4 |
|---|---|---|---|---|---|---|
| adrenal | 1.5e−01 | 2.1e−01 | 2.0e−02 | 4.6 | 4.4e−02 | 3.6 |
| bladder | 1.2e−01 | 9.2e−02 | 5.7e−02 | 4.1 | 2.1e−02 | 4.3 |
| bone | 4.9e−01 | 7.4e−01 | 4.1e−06 | 0.6 | 5.4e−01 | 0.4 |
| brain | 6.6e−01 | 7.0e−01 | 3.2e−01 | 0.6 | 1 | 0.4 |
| colon | 2.7e−01 | 4.0e−01 | 3.1e−01 | 1.5 | 5.2e−01 | 1.1 |
| epithelial | 2.0e−07 | 1.6e−03 | 9.8e−01 | 0.7 | 1 | 0.5 |
| general | 1.2e−06 | 1.2e−02 | 7.9e−01 | 0.8 | 1 | 0.6 |
| head and neck | 3.4e−01 | 5.0e−01 | 1 | 0.7 | 1 | 0.7 |
| kidney | 6.8e−01 | 7.4e−01 | 1 | 0.2 | 1 | 0.1 |
| liver | 3.3e−01 | 2.5e−01 | 1 | 1.8 | 2.3e−01 | 2.6 |
| lung | 4.3e−04 | 4.6e−03 | 2.1e−30 | 15.0 | 2.8e−27 | 23.5 |
| lymph nodes | 6.7e−01 | 8.7e−01 | 8.1e−01 | 0.7 | 9.9e−01 | 0.3 |
| breast | 2.3e−01 | 3.0e−01 | 1.9e−04 | 6.2 | 4.1e−03 | 4.3 |
| bone marrow | 7.5e−01 | 7.8e−01 | 1 | 0.3 | 2.0e−02 | 1.2 |
| muscle | 4.0e−02 | 7.5e−02 | 1.1e−01 | 4.6 | 5.1e−01 | 1.5 |
| ovary | 4.7e−02 | 8.4e−02 | 1.9e−05 | 5.4 | 8.3e−04 | 3.7 |
| pancreas | 5.0e−02 | 3.3e−01 | 1 | 0.3 | 1 | 0.2 |
| prostate | 8.5e−01 | 9.0e−01 | 8.9e−01 | 0.7 | 9.5e−01 | 0.6 |
| skin | 1.6e−01 | 1.6e−01 | 1.2e−10 | 12.6 | 5.2e−04 | 4.1 |
| stomach | 1.5e−01 | 6.3e−01 | 5.0e−01 | 1.2 | 9.4e−01 | 0.6 |
| Thyroid | 2.9e−01 | 2.9e−01 | 5.9e−02 | 2.0 | 5.9e−02 | 2.0 |
| uterus | 6.1e−02 | 5.7e−01 | 1.1e−01 | 1.3 | 7.0e−01 | 0.7 |

As noted above, cluster HUMOSTRO features 3 transcript(s), which were listed in Table 1 above. These transcript(s) encode for protein(s) which are variant(s) of protein Osteopontin precursor. A description of each variant protein according to the present invention is now provided.

Variant protein HUMOSTRO_PEA_1_PEA_1_P21 (SEQ ID NO: 311) according to the present invention has an amino acid sequence as given at the end of the application; it is encoded by transcript(s) HUMOSTRO_PEA_1_PEA_1_T14 (SEQ ID NO: 277). An alignment is given to the known protein (Osteopontin precursor) at the end of the application. One or more alignments to one or more previously published protein sequences are given at the end of the application. A brief description of the relationship of the variant protein according to the present invention to each such aligned protein is as follows:

Comparison report between HUMOSTRO_PEA_1_PEA_1_P21 (SEQ ID NO: 311) and OSTP_HUMAN:

1. An isolated chimeric polypeptide encoding for HUMOSTRO_PEA_1_PEA_1_P21 (SEQ ID NO: 311), comprising a first amino acid sequence being at least 90% homologous to MRIAVICFCLLGITCAIPVKQADSGS-SEEKQLYNKYPDAVATWLNPDPSQKQNLLAPQ corresponding to amino acids 1-58 of OSTP_HUMAN, which also corresponds to amino acids 1-58 of HUMOSTRO_PEA_1_PEA_1_P21 (SEQ ID NO: 311), and a second amino acid sequence being at least 70%, optionally at least 80%, preferably at least 85%, more preferably at least 90% and most preferably at least 95% homologous to a polypeptide having the sequence VFLNFS (SEQ ID NO: 1108) corresponding to amino acids 59-64 of HUMOSTRO_PEA_1_PEA_1_P21 (SEQ ID NO: 311), wherein said first amino acid sequence and second amino acid sequence are contiguous and in a sequential order.

2. An isolated polypeptide encoding for a tail of HUMOSTRO_PEA_1_PEA_1_P21 (SEQ ID NO: 311), comprising a polypeptide being at least 70%, optionally at least about 80%, preferably at least about 85%, more preferably at least about 90% and most preferably at least about 95% homologous to the sequence VFLNFS (SEQ ID NO: 1108) in HUMOSTRO_PEA_1_PEA_1_P21 (SEQ ID NO: 311).

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMOSTRO_PEA_1_PEA_1_P21 (SEQ ID NO: 311) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein HUMOSTRO_PEA_1_PEA_1_P21 (SEQ ID NO: 311) sequence provides support for the deduced sequence of this variant protein according to the present invention).

TABLE 7

Amino acid mutations

| SNP position(s) on amino acid sequence | Alternative amino acid(s) | Previously known SNP? |
|---|---|---|
| 7 | C -> W | No |
| 31 | Q -> R | No |
| 47 | D -> V | Yes |
| 49 | S -> P | No |

The glycosylation sites of variant protein HUMOSTRO_PEA_1_PEA_1_P21 (SEQ ID NO: 311), as compared to the known protein Osteopontin precursor, are described in Table 8 (given according to their position(s) on the amino acid sequence in the first column; the second column indicates whether the glycosylation site is present in the variant protein; and the last column indicates whether the position is different on the variant protein).

TABLE 8

Glycosylation site(s)

| Position(s) on known amino acid sequence | Present in variant protein? |
|---|---|
| 79 | no |
| 106 | no |

Variant protein HUMOSTRO_PEA_1_PEA_1_P21 (SEQ ID NO: 311) is encoded by the following transcript(s): HUMOSTRO_PEA_1_PEA_1_T14 (SEQ ID NO: 277), for which the sequence(s) is/are given at the end of the application. The coding portion of transcript HUMOSTRO_PEA_1_PEA_1_T14 (SEQ ID NO: 277) is shown in bold; this coding portion starts at position 199 and ends at position 390. The transcript also has the following SNPs as listed in Table 9 (given according to their position on the nucleotide sequence, with the alternative nucleic acid listed; the last column indicates whether the SNP is known or not; the presence of known SNPs in variant protein HUMOSTRO_PEA_1_PEA_1_P21 (SEQ ID NO: 311) sequence provides support for the deduced sequence of this variant protein according to the present invention).

TABLE 9

Nucleic acid SNPs

| SNP position on nucleotide sequence | Alternative nucleic acid | Previously known SNP? |
|---|---|---|
| 136 | A -> G | Yes |
| 154 | T -> | No |
| 159 | G -> T | Yes |
| 219 | C -> G | No |
| 274 | -> G | No |
| 290 | A -> G | No |
| 338 | A -> T | Yes |
| 343 | T -> C | No |
| 413 | G -> C | Yes |
| 707 | C -> T | Yes |
| 708 | C -> A | Yes |
| 715 | A -> G | Yes |
| 730 | A -> C | No |
| 730 | A -> G | No |
| 746 | T -> C | Yes |
| 767 | C -> T | No |
| 779 | G -> A | Yes |
| 866 | -> G | No |
| 869 | T -> | No |
| 889 | -> A | No |
| 891 | A -> C | No |
| 891 | A -> G | No |
| 905 | T -> C | No |
| 910 | -> G | No |
| 910 | -> T | No |
| 997 | A -> G | No |
| 1026 | G -> C | No |
| 1042 | -> G | No |
| 1042 | -> T | No |
| 1071 | A -> | No |
| 1071 | A -> C | No |
| 1098 | A -> | No |
| 1105 | C -> T | No |
| 1124 | -> G | No |
| 1135 | G -> A | Yes |
| 1136 | T -> | No |
| 1136 | T -> G | No |
| 1173 | A -> C | No |
| 1173 | A -> G | No |
| 1179 | A -> G | No |
| 1214 | C -> T | Yes |
| 1246 | T -> | No |
| 1246 | T -> A | No |

TABLE 9-continued

Nucleic acid SNPs

| SNP position on nucleotide sequence | Alternative nucleic acid | Previously known SNP? |
|---|---|---|
| 1359 | A -> | No |
| 1359 | A -> G | No |
| 1362 | T -> | No |
| 1365 | C -> T | Yes |
| 1366 | G -> A | Yes |
| 1408 | A -> C | No |
| 1418 | A -> C | No |
| 1433 | A -> C | No |
| 1456 | A -> C | No |
| 1524 | T -> A | No |
| 1524 | T -> C | No |
| 1547 | A -> G | Yes |
| 1553 | T -> | No |
| 1574 | -> G | No |
| 1654 | A -> C | Yes |
| 1691 | A -> G | No |
| 1703 | A -> C | Yes |
| 1755 | A -> C | No |
| 1764 | T -> | No |

Variant protein HUMOSTRO_PEA_1_PEA_1_P25 (SEQ ID NO: 312) according to the present invention has an amino acid sequence as given at the end of the application; it is encoded by transcript(s) HUMOSTRO_PEA_1_PEA_1_T16 (SEQ ID NO: 278). An alignment is given to the known protein (Osteopontin precursor) at the end of the application. One or more alignments to one or more previously published protein sequences are given at the end of the application. A brief description of the relationship of the variant protein according to the present invention to each such aligned protein is as follows:

Comparison report between HUMOSTRO_PEA_1_PEA_1_P25 (SEQ ID NO: 312) and OSTP_HUMAN:

1. An isolated chimeric polypeptide encoding for HUMOSTRO_PEA_1_PEA_1_P25 (SEQ ID NO: 312), comprising a first amino acid sequence being at least 90% homologous to MRIAVICFCLLGITCAIPVKQADSGS-SEEKQ corresponding to amino acids 1-31 of OSTP_HUMAN, which also corresponds to amino acids 1-31 of HUMOSTRO_PEA_1_PEA_1_P25 (SEQ ID NO: 312), and a second amino acid sequence being at least 70%, optionally at least 80%, preferably at least 85%, more preferably at least 90% and most preferably at least 95% homologous to a polypeptide having the sequence H corresponding to amino acids 32-32 of HUMOSTRO_PEA_1_PEA_1_P25 (SEQ ID NO: 312), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMOSTRO_PEA_1_PEA_1_P25 (SEQ ID NO: 312) also has the following non-silent SNPs (Single Nucleotide Polymorphisms) as listed in Table 10, (given according to their position(s) on the amino acid sequence, with the alternative amino acid(s) listed; the last column indicates whether the SNP is known or not; the presence of known SNPs in variant protein HUMOSTRO_PEA_1_PEA_1_P25 (SEQ ID NO: 312) sequence provides support for the deduced sequence of this variant protein according to the present invention).

TABLE 10

Amino acid mutations

| SNP position(s) on amino acid sequence | Alternative amino acid(s) | Previously known SNP? |
|---|---|---|
| 7 | C -> W | No |
| 31 | Q -> R | No |

The glycosylation sites of variant protein HUMOSTRO_PEA_1_PEA_1_P25 (SEQ ID NO: 312), as compared to the known protein Osteopontin precursor, are described in Table 11 (given according to their position(s) on the amino acid sequence in the first column; the second column indicates whether the glycosylation site is present in the variant protein; and the last column indicates whether the position is different on the variant protein).

TABLE 11

Glycosylation site(s)

| Position(s) on known amino acid sequence | Present in variant protein? |
|---|---|
| 79 | no |
| 106 | no |

Variant protein HUMOSTRO_PEA_1_PEA_1_P25 (SEQ ID NO: 312) is encoded by the following transcript(s): HUMOSTRO_PEA_1_PEA_1_T16 (SEQ ID NO: 278), for which the sequence(s) is/are given at the end of the application. The coding portion of transcript HUMOSTRO_PEA_1_PEA_1_T16 (SEQ ID NO: 278) is shown in bold; this coding portion starts at position 199 and ends at position 294. The transcript also has the following SNPs as listed in Table 12 (given according to their position on the nucleotide sequence, with the alternative nucleic acid listed; the last column indicates whether the SNP is known or not; the presence of known SNPs in variant protein HUMOSTRO_PEA_1_PEA_1_P25 (SEQ ID NO: 312) sequence provides support for the deduced sequence of this variant protein according to the present invention).

TABLE 12

Nucleic acid SNPs

| SNP position on nucleotide sequence | Alternative nucleic acid | Previously known SNP? |
|---|---|---|
| 136 | A -> G | Yes |
| 154 | T -> | No |
| 159 | G -> T | Yes |
| 219 | C -> G | No |
| 274 | -> G | No |
| 290 | A -> G | No |
| 419 | C -> T | Yes |
| 454 | G -> C | Yes |
| 527 | A -> T | Yes |
| 532 | T -> C | No |
| 630 | C -> T | Yes |
| 631 | C -> A | Yes |
| 638 | A -> G | Yes |
| 653 | A -> C | No |

TABLE 12-continued

Nucleic acid SNPs

| SNP position on nucleotide sequence | Alternative nucleic acid | Previously known SNP? |
|---|---|---|
| 653 | A -> G | No |
| 669 | T -> C | Yes |
| 690 | C -> T | No |
| 702 | G -> A | Yes |
| 789 | -> G | No |
| 792 | T -> | No |
| 812 | -> A | No |
| 814 | A -> C | No |
| 814 | A -> G | No |
| 828 | T -> C | No |
| 833 | -> G | No |
| 833 | -> T | No |
| 920 | A -> G | No |
| 949 | G -> C | No |
| 965 | -> G | No |
| 965 | -> T | No |
| 994 | A -> | No |
| 994 | A -> C | No |
| 1021 | A -> | No |
| 1028 | C -> T | No |
| 1047 | -> G | No |
| 1058 | G -> A | Yes |
| 1059 | T -> | No |
| 1059 | T -> G | No |
| 1096 | A -> C | No |
| 1096 | A -> G | No |
| 1102 | A -> G | No |
| 1137 | C -> T | Yes |
| 1169 | T -> | No |
| 1169 | T -> A | No |
| 1282 | A -> | No |
| 1282 | A -> G | No |
| 1285 | T -> | No |
| 1288 | C -> T | Yes |
| 1289 | G -> A | Yes |
| 1331 | A -> C | No |
| 1341 | A -> C | No |
| 1356 | A -> C | No |
| 1379 | A -> C | No |
| 1447 | T -> A | No |
| 1447 | T -> C | No |
| 1470 | A -> G | Yes |
| 1476 | T -> | No |
| 1497 | -> G | No |
| 1577 | A -> C | Yes |
| 1614 | A -> G | No |
| 1626 | A -> C | Yes |
| 1678 | A -> C | No |
| 1687 | T -> | No |

Variant protein HUMOSTRO_PEA_1_PEA_1_P30 (SEQ ID NO: 313) according to the present invention has an amino acid sequence as given at the end of the application; it is encoded by transcript(s) HUMOSTRO_PEA_1_PEA_1_T30 (SEQ ID NO: 279). An alignment is given to the known protein (Osteopontin precursor) at the end of the application. One or more alignments to one or more previously published protein sequences are given at the end of the application. A brief description of the relationship of the variant protein according to the present invention to each such aligned protein is as follows:

Comparison report between HUMOSTRO_PEA_1_PEA_1_P30 (SEQ ID NO: 313) and OSTP_HUMAN:

1. An isolated chimeric polypeptide encoding for HUMOSTRO_PEA_1_PEA_1_P30 (SEQ ID NO: 313), comprising a first amino acid sequence being at least 90% homologous to MRIAVICFCLLGITCAIPVKQADSGS-SEEKQ corresponding to amino acids 1-31 of OSTP_HUMAN, which also corresponds to amino acids 1-31 of HUMOSTRO_PEA_1_PEA_1_P30 (SEQ ID NO: 313), and a second amino acid sequence being at least 70%, optionally at least 80%, preferably at least 85%, more preferably at least 90% and most preferably at least 95% homologous to a polypeptide having the sequence VSIFYVFI (SEQ ID NO: 1109) corresponding to amino acids 32-39 of HUMOSTRO_PEA_1_PEA_1_P30 (SEQ ID NO: 313), wherein said first amino acid sequence and second amino acid sequence are contiguous and in a sequential order.

2. An isolated polypeptide encoding for a tail of HUMOSTRO_PEA_1_PEA_1_P30 (SEQ ID NO: 313), comprising a polypeptide being at least 70%, optionally at least about 80%, preferably at least about 85%, more preferably at least about 90% and most preferably at least about 95% homologous to the sequence VSIFYVFI (SEQ ID NO: 1109) in HUMOSTRO_PEA_1_PEA_1_P30 (SEQ ID NO: 313).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMOSTRO_PEA_1_PEA_1_P30 (SEQ ID NO: 313) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein HUMOSTRO_PEA_1_PEA_1_P30 (SEQ ID NO: 313) sequence provides support for the deduced sequence of this variant protein according to the present invention).

TABLE 13

Amino acid mutations

| SNP position(s) on amino acid sequence | Alternative amino acid(s) | Previously known SNP? |
|---|---|---|
| 7 | C -> W | No |
| 31 | Q -> R | No |

The glycosylation sites of variant protein HUMOSTRO_PEA_1_PEA_1_P30 (SEQ ID NO: 313), as compared to the known protein Osteopontin precursor, are described in Table 14 (given according to their position(s) on the amino acid sequence in the first column; the second column indicates whether the glycosylation site is present in the variant protein; and the last column indicates whether the position is different on the variant protein).

TABLE 14

Glycosylation site(s)

| Position(s) on known amino acid sequence | Present in variant protein? |
|---|---|
| 79 | no |
| 106 | no |

Variant protein HUMOSTRO_PEA_1_PEA_1_P30 (SEQ ID NO: 313) is encoded by the following transcript(s): HUMOSTRO_PEA_1_PEA_1_T30 (SEQ ID NO: 279), for which the sequence(s) is/are given at the end of the application. The coding portion of transcript HUMOSTRO_PEA_1_PEA_1_T30 (SEQ ID NO: 279) is shown in bold; this coding portion starts at position 199 and ends at position 315. The transcript also has the following SNPs as listed in Table 15 (given according to their position on the nucleotide sequence, with the alternative nucleic acid listed; the last column indicates whether the SNP is known or not; the presence of known SNPs in variant protein HUMOSTRO_PEA_1_PEA_1_P30 (SEQ ID NO: 313) sequence provides support for the deduced sequence of this variant protein according to the present invention).

TABLE 15

Nucleic acid SNPs

| SNP position on nucleotide sequence | Alternative nucleic acid | Previously known SNP? |
|---|---|---|
| 136 | A -> G | Yes |
| 154 | T -> | No |
| 159 | G -> T | Yes |
| 219 | C -> G | No |
| 274 | -> G | No |
| 290 | A -> G | No |

As noted above, cluster HUMOSTRO features 30 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMOSTRO_PEA_1_PEA_1_node_0 (SEQ ID NO: 280) according to the present invention is supported by 333 libraries. The number of libraries was determined as previously described. This segment can be found in the following transcript(s): HUMOSTRO_PEA_1_PEA_1_T14 (SEQ ID NO: 277), HUMOSTRO_PEA_1_PEA_1_T16 (SEQ ID NO: 278) and HUMOSTRO_PEA_1_PEA_1_T30 (SEQ ID NO: 279). Table 16 below describes the starting and ending position of this segment on each transcript.

TABLE 16

Segment location on transcripts

| Transcript name | Segment starting position | Segment ending position |
|---|---|---|
| HUMOSTRO_PEA_1_PEA_1_T14 (SEQ ID NO:277) | 1 | 184 |
| HUMOSTRO_PEA_1_PEA_1_T16 (SEQ ID NO:278) | 1 | 184 |
| HUMOSTRO_PEA_1_PEA_1_T30 (SEQ ID NO:279) | 1 | 184 |

Segment cluster HUMOSTRO_PEA_1_PEA_1_node_10 (SEQ ID NO: 281) according to the present invention is supported by 4 libraries. The number of libraries was determined as previously described. This segment can be found in the following transcript(s): HUMOSTRO_PEA_1_PEA_1_T16 (SEQ ID NO: 278). Table 17 below describes the starting and ending position of this segment on each transcript.

TABLE 17

Segment location on transcripts

| Transcript name | Segment starting position | Segment ending position |
|---|---|---|
| HUMOSTRO_PEA_1_PEA_1_T16 (SEQ ID NO:278) | 292 | 480 |

Segment cluster HUMOSTRO_PEA_1_PEA_1_node_16 (SEQ ID NO: 282) according to the present invention is supported by 6 libraries. The number of libraries was determined as previously described. This segment can be found in the following transcript(s): HUMOSTRO_PEA_1_PEA_1_T14 (SEQ ID NO: 277). Table 18 below describes the starting and ending position of this segment on each transcript.

TABLE 18

Segment location on transcripts

| Transcript name | Segment starting position | Segment ending position |
|---|---|---|
| HUMOSTRO_PEA_1_PEA_1_T14 (SEQ ID NO:277) | 373 | 638 |

Segment cluster HUMOSTRO_PEA_1_PEA_1_node_23 (SEQ ID NO: 283) according to the present invention is supported by 334 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 19 below describes the starting and ending position of this segment on each transcript.

TABLE 19

Segment location on transcripts

| Transcript name | Segment starting position | Segment ending position |
|---|---|---|
| HUMOSTRO_PEA_1_PEA_1_T14 (SEQ ID NO:277) | 804 | 967 |
| HUMOSTRO_PEA_1_PEA_1_T16 (SEQ ID NO:278) | 727 | 890 |

Segment cluster HUMOSTRO_PEA_1_PEA_1_node_31 (SEQ ID NO: 284) according to the present invention is supported by 350 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 20 below describes the starting and ending position of this segment on each transcript.

TABLE 20

Segment location on transcripts

| Transcript name | Segment starting position | Segment ending position |
|---|---|---|
| HUMOSTRO_PEA_1_PEA_1_T14 (SEQ ID NO:277) | 1164 | 1393 |
| HUMOSTRO_PEA_1_PEA_1_T16 (SEQ ID NO:278) | 1087 | 1316 |

Segment cluster HUMOSTRO_PEA_1_PEA_1_node_43 (SEQ ID NO: 285) according to the present invention is supported by 192 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 21 below describes the starting and ending position of this segment on each transcript.

TABLE 21

Segment location on transcripts

| Transcript name | Segment starting position | Segment ending position |
|---|---|---|
| HUMOSTRO_PEA_1_PEA_1_T14 (SEQ ID NO:277) | 1810 | 1846 |
| HUMOSTRO_PEA_1_PEA_1_T16 (SEQ ID NO:278) | 1733 | 1769 |

According to an optional embodiment of the present invention, short segments related to the above cluster are also provided. These segments are up to about 120 bp in length, and so are included in a separate description.

Segment cluster HUMOSTRO_PEA_1_PEA_1_node_3 according to the present invention is supported by 353 libraries. The number of libraries was determined as previously described. This segment can be found in the following transcript(s): HUMOSTRO_PEA_1_PEA_1_T14 (SEQ ID NO: 277), HUMOSTRO_PEA_1_PEA_1_T16 (SEQ ID NO: 278) and HUMOSTRO_PEA_1_PEA_1_T30 (SEQ ID NO: 279). Table 22 below describes the starting and ending position of this segment on each transcript.

TABLE 22

Segment location on transcripts

| Transcript name | Segment starting position | Segment ending position |
|---|---|---|
| HUMOSTRO_PEA_1_PEA_1_T14 (SEQ ID NO:277) | 185 | 210 |
| HUMOSTRO_PEA_1_PEA_1_T16 (SEQ ID NO:278) | 185 | 210 |
| HUMOSTRO_PEA_1_PEA_1_T30 (SEQ ID NO:279) | 185 | 210 |

Segment cluster HUMOSTRO_PEA_1_PEA_1_node_5 (SEQ ID NO: 287) according to the present invention is supported by 353 libraries. The number of libraries was determined as previously described. This segment can be found in the following transcript(s): HUMOSTRO_PEA_1_PEA_1_T14 (SEQ ID NO: 277), HUMOSTRO_PEA_1_PEA_1_T16 (SEQ ID NO: 278) and HUMOSTRO_PEA_1_PEA_1_T30 (SEQ ID NO: 279). Table 23 below describes the starting and ending position of this segment on each transcript.

TABLE 23

Segment location on transcripts

| Transcript name | Segment starting position | Segment ending position |
|---|---|---|
| HUMOSTRO_PEA_1_PEA_1_T14 (SEQ ID NO:277) | 211 | 252 |
| HUMOSTRO_PEA_1_PEA_1_T16 (SEQ ID NO:278) | 211 | 252 |
| HUMOSTRO_PEA_1_PEA_1_T30 (SEQ ID NO:279) | 211 | 252 |

Segment cluster HUMOSTRO_PEA_1_PEA_1_node_7 (SEQ ID NO: 288) according to the present invention is supported by 357 libraries. The number of libraries was determined as previously described. This segment can be found in the following transcript(s): HUMOSTRO_PEA_1_PEA_1_T14 (SEQ ID NO: 277), HUMOSTRO_PEA_1_PEA_1_T16 (SEQ ID NO: 278) and HUMOSTRO_PEA_1_PEA_1_T30 (SEQ ID NO: 279). Table 24 below describes the starting and ending position of this segment on each transcript.

TABLE 24

Segment location on transcripts

| Transcript name | Segment starting position | Segment ending position |
|---|---|---|
| HUMOSTRO_PEA_1_PEA_1_T14 (SEQ ID NO:277) | 253 | 291 |
| HUMOSTRO_PEA_1_PEA_1_T16 (SEQ ID NO:278) | 253 | 291 |
| HUMOSTRO_PEA_1_PEA_1_T30 (SEQ ID NO:279) | 253 | 291 |

Segment cluster HUMOSTRO_PEA_1_PEA_1_node_8 (SEQ ID NO: 289) according to the present invention is supported by 1 library. The number of libraries was determined as previously described. This segment can be found in the following transcript(s): HUMOSTRO_PEA_1_PEA_1_T30 (SEQ ID NO: 279). Table 25 below describes the starting and ending position of this segment on each transcript.

TABLE 25

Segment location on transcripts

| Transcript name | Segment starting position | Segment ending position |
|---|---|---|
| HUMOSTRO_PEA_1_PEA_1_T30 (SEQ ID NO:279) | 292 | 378 |

Segment cluster HUMOSTRO_PEA_1_PEA_1_node_15 (SEQ ID NO: 290) according to the present invention is supported by 366 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 26 below describes the starting and ending position of this segment on each transcript.

TABLE 26

Segment location on transcripts

| Transcript name | Segment starting position | Segment ending position |
|---|---|---|
| HUMOSTRO_PEA_1_PEA_1_T14 (SEQ ID NO:277) | 292 | 372 |
| HUMOSTRO_PEA_1_PEA_1_T16 (SEQ ID NO:278) | 481 | 561 |

Segment cluster HUMOSTRO_PEA_1_PEA_1_node_17 (SEQ ID NO: 291) according to the present invention is supported by 261 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 27 below describes the starting and ending position of this segment on each transcript.

TABLE 27

Segment location on transcripts

| Transcript name | Segment starting position | Segment ending position |
|---|---|---|
| HUMOSTRO_PEA_1_PEA_1_T14 (SEQ ID NO:277) | 639 | 680 |
| HUMOSTRO_PEA_1_PEA_1_T16 (SEQ ID NO:278) | 562 | 603 |

Segment cluster HUMOSTRO_PEA_1_PEA_1_node_20 (SEQ ID NO: 292) according to the present invention can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 28 below describes the starting and ending position of this segment on each transcript.

TABLE 28

Segment location on transcripts

| Transcript name | Segment starting position | Segment ending position |
|---|---|---|
| HUMOSTRO_PEA_1_PEA_1_T14 (SEQ ID NO:277) | 681 | 688 |
| HUMOSTRO_PEA_1_PEA_1_T16 (SEQ ID NO:278) | 604 | 611 |

Segment cluster HUMOSTRO_PEA_1_PEA_1_node_21 (SEQ ID NO: 293) according to the present invention is supported by 315 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 29 below describes the starting and ending position of this segment on each transcript.

TABLE 29

Segment location on transcripts

| Transcript name | Segment starting position | Segment ending position |
|---|---|---|
| HUMOSTRO_PEA_1_PEA_1_T14 (SEQ ID NO:277) | 689 | 738 |
| HUMOSTRO_PEA_1_PEA_1_T16 (SEQ ID NO:278) | 612 | 661 |

Segment cluster HUMOSTRO_PEA_1_PEA_1_node_22 (SEQ ID NO: 294) according to the present invention is supported by 322 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 30 below describes the starting and ending position of this segment on each transcript.

TABLE 30

Segment location on transcripts

| Transcript name | Segment starting position | Segment ending position |
|---|---|---|
| HUMOSTRO_PEA_1_PEA_1_T14 (SEQ ID NO:277) | 739 | 803 |
| HUMOSTRO_PEA_1_PEA_1_T16 (SEQ ID NO:278) | 662 | 726 |

Segment cluster HUMOSTRO_PEA_1_PEA_1_node_24 (SEQ ID NO: 295) according to the present invention is supported by 270 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 31 below describes the starting and ending position of this segment on each transcript.

TABLE 31

Segment location on transcripts

| Transcript name | Segment starting position | Segment ending position |
|---|---|---|
| HUMOSTRO_PEA_1_PEA_1_T14 (SEQ ID NO:277) | 968 | 1004 |
| HUMOSTRO_PEA_1_PEA_1_T16 (SEQ ID NO:278) | 891 | 927 |

Segment cluster HUMOSTRO_PEA_1_PEA_1_node_26 (SEQ ID NO: 296) according to the present invention can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 32 below describes the starting and ending position of this segment on each transcript.

TABLE 32

Segment location on transcripts

| Transcript name | Segment starting position | Segment ending position |
|---|---|---|
| HUMOSTRO_PEA_1_PEA_1_T14 (SEQ ID NO:277) | 1005 | 1022 |
| HUMOSTRO_PEA_1_PEA_1_T16 (SEQ ID NO:278) | 928 | 945 |

Segment cluster HUMOSTRO_PEA_1_PEA_1_node_27 (SEQ ID NO: 297) according to the present invention is supported by 260 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 33 below describes the starting and ending position of this segment on each transcript.

TABLE 33

Segment location on transcripts

| Transcript name | Segment starting position | Segment ending position |
|---|---|---|
| HUMOSTRO_PEA_1_PEA_1_T14 (SEQ ID NO:277) | 1023 | 1048 |
| HUMOSTRO_PEA_1_PEA_1_T16 (SEQ ID NO:278) | 946 | 971 |

Segment cluster HUMOSTRO_PEA_1_PEA_1_node_28 (SEQ ID NO: 298) according to the present invention is supported by 273 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 34 below describes the starting and ending position of this segment on each transcript.

TABLE 34

Segment location on transcripts

| Transcript name | Segment starting position | Segment ending position |
|---|---|---|
| HUMOSTRO_PEA_1_PEA_1_T14 (SEQ ID NO:277) | 1049 | 1100 |
| HUMOSTRO_PEA_1_PEA_1_T16 (SEQ ID NO:278) | 972 | 1023 |

Segment cluster HUMOSTRO_PEA_1_PEA_1_node_29 (SEQ ID NO: 299) according to the present invention is supported by 272 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 35 below describes the starting and ending position of this segment on each transcript.

TABLE 35

Segment location on transcripts

| Transcript name | Segment starting position | Segment ending position |
|---|---|---|
| HUMOSTRO_PEA_1_PEA_1_T14 (SEQ ID NO:277) | 1101 | 1151 |
| HUMOSTRO_PEA_1_PEA_1_T16 (SEQ ID NO:278) | 1024 | 1074 |

Segment cluster HUMOSTRO_PEA_1_PEA_1_node_30 (SEQ ID NO. 300) according to the present invention can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 36 below describes the starting and ending position of this segment on each transcript.

TABLE 36

Segment location on transcripts

| Transcript name | Segment starting position | Segment ending position |
|---|---|---|
| HUMOSTRO_PEA_1_PEA_I_T14 (SEQ ID NO:277) | 1152 | 1163 |
| HUMOSTRO_PEA_1_PEA_1_T16 (SEQ ID NO:278) | 1075 | 1086 |

Segment cluster HUMOSTRO_PEA_1_PEA_1_node_32 (SEQ ID NO: 301) according to the present invention is supported by 293 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 37 below describes the starting and ending position of this segment on each transcript.

TABLE 37

Segment location on transcripts

| Transcript name | Segment starting position | Segment ending position |
|---|---|---|
| HUMOSTRO_PEA_1_PEA_1_T14 (SEQ ID NO:277) | 1394 | 1427 |
| HUMOSTRO_PEA_1_PEA_1_T16 (SEQ ID NO:278) | 1317 | 1350 |

Segment cluster HUMOSTRO_PEA_1_PEA_1_node_34 (SEQ ID NO: 302) according to the present invention is supported by 301 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 38 below describes the starting and ending position of this segment on each transcript.

TABLE 38

Segment location on transcripts

| Transcript name | Segment starting position | Segment ending position |
|---|---|---|
| HUMOSTRO_PEA_1_PEA_1_T14 (SEQ ID NO:277) | 1428 | 1468 |
| HUMOSTRO_PEA_1_PEA_1_T16 (SEQ ID NO:278) | 1351 | 1391 |

Segment cluster HUMOSTRO_PEA_1_PEA_1_node_36 according to the present invention is supported by 292 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 39 below describes the starting and ending position of this segment on each transcript.

TABLE 39

Segment location on transcripts

| Transcript name | Segment starting position | Segment ending position |
|---|---|---|
| HUMOSTRO_PEA_1_PEA_1_T14 (SEQ ID NO:277) | 1469 | 1504 |
| HUMOSTRO_PEA_1_PEA_1_T16 (SEQ ID NO:278) | 1392 | 1427 |

Segment cluster HUMOSTRO_PEA_1_PEA_1_node_37 (SEQ ID NO: 304) according to the present invention is supported by 295 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 40 below describes the starting and ending position of this segment on each transcript.

TABLE 40

Segment location on transcripts

| Transcript name | Segment starting position | Segment ending position |
|---|---|---|
| HUMOSTRO_PEA_1_PEA_1_T14 (SEQ ID NO:277) | 1505 | 1623 |
| HUMOSTRO_PEA_1_PEA_1_T16 (SEQ ID NO:278) | 1428 | 1546 |

Segment cluster HUMOSTRO_PEA_1_PEA_1_node_38 (SEQ ID NO: 305) according to the present invention can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 41 below describes the starting and ending position of this segment on each transcript.

TABLE 41

Segment location on transcripts

| Transcript name | Segment starting position | Segment ending position |
|---|---|---|
| HUMOSTRO_PEA_1_PEA_1_T14 (SEQ ID NO: 277) | 1624 | 1634 |
| HUMOSTRO_PEA_1_PEA_1_T16 (SEQ ID NO: 278) | 1547 | 1557 |

Segment cluster HUMOSTRO_PEA_1_PEA_1_node_39 (SEQ ID NO: 306) according to the present invention is supported by 268 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 42 below describes the starting and ending position of this segment on each transcript.

TABLE 42

Segment location on transcripts

| Transcript name | Segment starting position | Segment ending position |
|---|---|---|
| HUMOSTRO_PEA_1_PEA_1_T14 (SEQ ID NO: 277) | 1635 | 1725 |
| HUMOSTRO_PEA_1_PEA_1_T16 (SEQ ID NO: 278) | 1558 | 1648 |

Segment cluster HUMOSTRO_PEA_1_PEA_1_node_40 (SEQ ID NO: 307) according to the present invention can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 43 below describes the starting and ending position of this segment on each transcript.

TABLE 43

Segment location on transcripts

| Transcript name | Segment starting position | Segment ending position |
|---|---|---|
| HUMOSTRO_PEA_1_PEA_1_T14 (SEQ ID NO: 277) | 1726 | 1743 |
| HUMOSTRO_PEA_1_PEA_1_T16 (SEQ ID NO: 278) | 1649 | 1666 |

Segment cluster HUMOSTRO_PEA_1_PEA_1_node_41 (SEQ ID NO: 308) according to the present invention can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 44 below describes the starting and ending position of this segment on each transcript.

TABLE 44

Segment location on transcripts

| Transcript name | Segment starting position | Segment ending position |
|---|---|---|
| HUMOSTRO_PEA_1_PEA_1_T14 (SEQ ID NO: 277) | 1744 | 1749 |
| HUMOSTRO_PEA_1_PEA_1_T16 (SEQ ID NO: 278) | 1667 | 1672 |

Segment cluster HUMOSTRO_PEA_1_PEA_1_node_42 (SEQ ID NO: 309) according to the present invention is supported by 224 libraries. The number of libraries was determined as previously described. This segment can be found in the following transcript(s): HUMOSTRO_PEA_1_PEA_1_T14 (SEQ ID NO: 277) and HUMOSTRO_PEA_1_PEA_1_T16 (SEQ ID NO: 278). Table 45 below describes the starting and ending position of this segment on each transcript.

TABLE 45

Segment location on transcripts

| Transcript name | Segment starting position | Segment ending position |
|---|---|---|
| HUMOSTRO_PEA_1_PEA_1_T14 (SEQ ID NO: 277) | 1750 | 1809 |
| HUMOSTRO_PEA_1_PEA_1_T16 (SEQ ID NO: 278) | 1673 | 1732 |

Variant protein alignment to the previously known protein:

Sequence name: OSTP_HUMAN

Sequence documentation:

Alignment of: HUMOSTRO_PEA_1_PEA_1_P21 (SEQ ID NO: 311) x OSTP_HUMAN . . .

Alignment segment 1/1:
 Quality: 578.00

Escore: 0
 Matching length: 58 Total length: 58

Matching Percent Similarity: 100.00 Matching Percent Identity: 100.00
  Total Percent Similarity: 100.00 Total Percent Identity: 100.00
    Gaps: 0
Alignment:

```
 1 MRIAVICFCLLGITCAIPVKQADSGSSEEKQLYNKYPDAVATWLNPDPSQ 50
   ||||||||||||||||||||||||||||||||||||||||||||||||||
 1 MRIAVICFCLLGITCAIPVKQADSGSSEEKQLYNKYPDAVATWLNPDPSQ 50

51 KQNLLAPQ                                           58
   ||||||||
51 KQNLLAPQ                                           58
```

Sequence name: OSTP_HUMAN

Sequence documentation:

Alignment of: HUMOSTRO_PEA_1_PEA_1_P25 (SEQ ID NO: 312) x OSTP_HUMAN . . .

Alignment segment 1/1:
  Quality: 301.00

Escore: 0

Matching length: 31 Total length: 31

Matching Percent Similarity: 100.00 Matching Percent Identity: 100.00
  Total Percent Similarity: 100.00 Total Percent Identity: 100.00
    Gaps: 0
Alignment:

```
 1 MRIAVICFCLLGITCAIPVKQADSGSSEEKQ  31
   |||||||||||||||||||||||||||||||
 1 MRIAVICFCLLGITCAIPVKQADSGSSEEKQ  31
```

Sequence name: OSTP_HUMAN

Sequence documentation:

Alignment of: HUMOSTRO_PEA_1_PEA_1_P30 (SEQ ID NO: 313) x OSTP_HUMAN . . .

Alignment segment 1/1:
  Quality: 301.00

Escore: 0
  Matching length: 31 Total length: 31
Matching Percent Similarity: 100.00 Matching Percent Identity: 100.00
  Total Percent Similarity: 100.00 Total Percent Identity: 100.00
    Gaps: 0
Alignment:

```
 1 MRIAVICFCLLGITCAIPVKQADSGSSEEKQ  31
   |||||||||||||||||||||||||||||||
 1 MRIAVICFCLLGITCAIPVKQADSGSSEEKQ  31
```

DESCRIPTION FOR CLUSTER T46984

Cluster T46984 features 21 transcript(s) and 49 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
| --- | --- |
| T46984_PEA_1_T2 | 314 |
| T46984_PEA_1_T3 | 315 |
| T46984_PEA_1_T12 | 316 |
| T46984_PEA_1_T13 | 317 |
| T46984_PEA_1_T14 | 318 |
| T46984_PEA_1_T15 | 319 |
| T46984_PEA_1_T19 | 320 |
| T46984_PEA_1_T23 | 321 |
| T46984_PEA_1_T27 | 322 |
| T46984_PEA_1_T32 | 323 |
| T46984_PEA_1_T34 | 324 |
| T46984_PEA_1_T35 | 325 |
| T46984_PEA_1_T40 | 326 |
| T46984_PEA_1_T42 | 327 |
| T46984_PEA_1_T43 | 328 |
| T46984_PEA_1_T46 | 329 |
| T46984_PEA_1_T47 | 330 |
| T46984_PEA_1_T48 | 331 |
| T46984_PEA_1_T51 (SEQ ID NO:332) | 332 |
| T46984_PEA_1_T52 | 333 |
| T46984_PEA_1_T54 | 334 |

TABLE 2

Segments of interest

| Segment Name | SEQ ID NO: |
| --- | --- |
| T46984_PEA_1_node_2 | 335 |
| T46984_PEA_1_node_4 | 336 |
| T46984_PEA_1_node_6 | 337 |
| T46984_PEA_1_node_12 | 338 |
| T46984_PEA_1_node_14 | 339 |
| T46984_PEA_1_node_25 | 340 |
| T46984_PEA_1_node_29 | 341 |
| T46984_PEA_1_node_34 | 342 |
| T46984_PEA_1_node_46 | 343 |
| T46984_PEA_1_node_47 | 344 |
| T46984_PEA_1_node_52 | 345 |
| T46984_PEA_1_node_65 | 346 |
| T46984_PEA_1_node_69 | 347 |
| T46984_PEA_1_node_75 | 348 |
| T46984_PEA_1_node_86 | 349 |
| T46984_PEA_1_node_9 | 350 |
| T46984_PEA_1_node_13 | 351 |
| T46984_PEA_1_node_19 | 352 |
| T46984_PEA_1_node_21 | 353 |
| T46984_PEA_1_node_22 | 354 |
| T46984_PEA_1_node_26 | 355 |
| T46984_PEA_1_node_28 | 356 |
| T46984_PEA_1_node_31 | 357 |
| T46984_PEA_1_node_32 | 358 |
| T46984_PEA_1_node_38 | 359 |
| T46984_PEA_1_node_39 | 360 |
| T46984_PEA_1_node_40 | 361 |
| T46984_PEA_1_node_42 | 362 |
| T46984_PEA_1_node_43 | 363 |
| T46984_PEA_1_node_48 | 364 |
| T46984_PEA_1_node_49 | 365 |
| T46984_PEA_1_node_50 | 366 |
| T46984_PEA_1_node_51 | 367 |
| T46984_PEA_1_node_53 | 368 |
| T46984_PEA_1_node_54 | 369 |
| T46984_PEA_1_node_55 | 370 |
| T46984_PEA_1_node_57 | 371 |
| T46984_PEA_1_node_60 | 372 |
| T46984_PEA_1_node_62 | 373 |
| T46984_PEA_1_node_66 | 374 |
| T46984_PEA_1_node_67 | 375 |
| 146984_PEA_1_node_70 | 376 |
| T46984_PEA_1_node_71 | 377 |
| T46984_PEA_1_node_72 | 378 |
| T46984_PEA_1_node_73 | 379 |
| T46984_PEA_1_node_74 | 380 |
| T46984_PEA_1_node_83 | 381 |
| T46984_PEA_1_node_84 | 382 |
| T46984_PEA_1_node_85 | 383 |

TABLE 3

Proteins of interest

| Protein Name | SEQ ID NO: | Corresponding Transcript(s) |
| --- | --- | --- |
| T46984_PEA_1_P2 | 385 | T46984_PEA_1_T2 (SEQ ID NO: 314); T46984_PEA_1_T12 (SEQ ID NO: 316); T46984_PEA_1_T23 (SEQ ID NO: 321) |
| T46984_PEA_1_P3 | 386 | T46984_PEA_1_T3 (SEQ ID NO: 315); T46984_PEA_1_T19 (SEQ ID NO: 320) |
| T46984_PEA_1_P10 | 387 | T46984_PEA_1_T13 (SEQ ID NO: 317) |
| T46984_PEA_1_P11 | 388 | T46984_PEA_1_T14 (SEQ ID NO: 318) |
| T46984_PEA_1_P12 | 389 | T46984_PEA_1_T15 (SEQ ID NO: 319) |
| T46984_PEA_1_P21 | 390 | T46984_PEA_1_T27 (SEQ ID NO: 322) |
| T46984_PEA_1_P27 | 391 | T46984_PEA_1_T34 (SEQ ID NO: 324) |
| T46984_PEA_1_P32 | 392 | T46984_PEA_1_T40 (SEQ ID NO: 326) |
| T46984_PEA_1_P34 | 393 | T46984_PEA_1_T42 (SEQ ID NO: 327) |
| T46984_PEA_1_P35 | 394 | T46984_PEA_1_T43 (SEQ ID NO: 328) |
| T46984_PEA_1_P38 | 395 | T46984_PEA_1_T47 (SEQ ID NO: 330) |
| T46984_PEA_1_P39 | 396 | T46984_PEA_1_T48 (SEQ ID NO: 331) |
| T46984_PEA_1_P45 | 397 | T46984_PEA_1_T32 (SEQ ID NO: 323) |
| T46984_PEA_1_P46 | 398 | T46984_PEA_1_T35 (SEQ ID NO: 325) |

These sequences are variants of the known protein Dolichyl-diphosphooligosaccharide—protein glycosyltransferase 63 kDa subunit precursor (SwissProt accession identifier RIB2_HUMAN; known also according to the synonyms EC 2.4.1.119; Ribophorin II; RPN-II; RIBIIR), SEQ ID NO: 384, referred to herein as the previously known protein.

Protein Dolichyl-diphosphooligosaccharide—protein glycosyltransferase 63 kDa subunit precursor is known or believed to have the following function(s): Essential subunit of N-oligosaccharyl transferase enzyme which catalyzes the transfer of a high mannose oligosaccharide from a lipid-linked oligosaccharide donor to an asparagine residue within an Asn-X-Ser/Thr consensus motif in nascent polypeptide chains. The sequence for protein Dolichyl-diphosphooligosaccharide—protein glycosyltransferase 63 kDa subunit precursor is given at the end of the application, as "Dolichyl-diphosphooligosaccharide—protein glycosyltransferase 63 kDa subunit precursor amino acid sequence". Known polymorphisms for this sequence are as shown in Table 4.

TABLE 4

Amino acid mutations for Known Protein

| SNP position(s) on amino acid sequence | Comment |
|---|---|
| 197 | V -> L |
| 201 | F -> C |
| 260 | A -> S |
| 423 | V -> M |

Protein Dolichyl-diphosphooligosaccharide—protein glycosyltransferase 63 kDa subunit precursor localization is believed to be Type I membrane protein. Endoplasmic reticulum.

The following GO Annotation(s) apply to the previously known protein. The following annotation(s) were found: protein modification, which are annotation(s) related to Biological Process; oligosaccharyl transferase; dolichyl-diphosphooligosaccharide-protein glycosyltransferase; transferase, which are annotation(s) related to Molecular Function; and oligosaccharyl transferase complex; integral membrane protein, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster T46984 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 39 refer to weighted expression of ESTs in each category, as "parts per million" (ratio of the expression of ESTs for a particular cluster to the expression of all ESTs in that category, according to parts per million).

Figure 39:
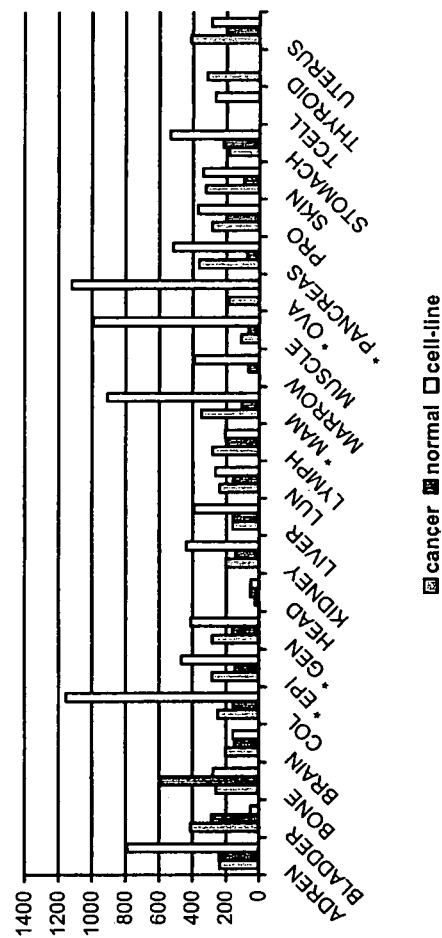
FIG. 39 shows cancer and cell-line vs. normal tissue expression.

Overall, the following results were obtained as shown with regard to the histograms in FIG. 39 and Table 5. This cluster is overexpressed (at least at a minimum level) in the following pathological conditions: epithelial malignant tumors, a mixture of malignant tumors from different tissues, breast malignant tumors, ovarian carcinoma and pancreas carcinoma.

TABLE 5

Normal tissue distribution

| Name of Tissue | Number |
|---|---|
| adrenal | 240 |
| bladder | 287 |
| Bone | 592 |
| Brain | 145 |
| Colon | 157 |
| epithelial | 144 |
| general | 163 |
| head and neck | 50 |
| Kidney | 139 |
| Liver | 156 |
| Lung | 155 |
| Lymph nodes | 194 |
| Breast | 105 |
| bone marrow | 62 |
| Muscle | 62 |
| Ovary | 0 |
| pancreas | 72 |
| prostate | 201 |
| Skin | 91 |
| stomach | 219 |
| T cells | 0 |
| Thyroid | 0 |
| Uterus | 200 |

TABLE 6

P values and ratios for expression in cancerous tissue

| Name of Tissue | P1 | P2 | SP1 | R3 | SP2 | R4 |
|---|---|---|---|---|---|---|
| adrenal | 6.3e−01 | 5.4e−01 | 6.2e−01 | 0.8 | 2.5e−01 | 1.0 |
| bladder | 5.4e−01 | 5.9e−01 | 3.0e−01 | 1.0 | 6.5e−01 | 0.7 |
| Bone | 3.9e−01 | 3.7e−01 | 9.8e−01 | 0.4 | 9.9e−01 | 0.4 |
| Brain | 3.3e−01 | 2.9e−01 | 1.4e−01 | 1.2 | 2.0e−01 | 1.0 |
| Colon | 8.6e−02 | 5.9e−02 | 2.6e−01 | 1.3 | 2.1e−03 | 1.4 |
| epithelial | 5.3e−05 | 6.2e−07 | 2.8e−08 | 1.9 | 3.4e−21 | 2.4 |
| general | 1.0e−04 | 7.3e−08 | 9.3e−12 | 1.7 | 8.0e−33 | 2.0 |
| head and neck | 4.5e−01 | 5.4e−01 | 1 | 0.8 | 7.5e−01 | 0.9 |
| Kidney | 6.6e−01 | 6.5e−01 | 3.2e−01 | 1.2 | 5.3e−02 | 1.5 |
| Liver | 5.5e−01 | 5.6e−01 | 6.5e−01 | 1.0 | 1.2e−01 | 1.4 |
| Lung | 3.0e−01 | 1.7e−01 | 1.5e−01 | 1.4 | 6.0e−02 | 1.4 |
| Lymph nodes | 2.9e−01 | 5.5e−01 | 2.9e−01 | 0.8 | 4.3e−01 | 1.0 |
| Breast | 2.4e−02 | 5.8e−03 | 3.7e−02 | 2.2 | 1.7e−04 | 2.7 |
| bone marrow | 7.1e−01 | 7.5e−01 | 1 | 0.3 | 1.2e−02 | 1.8 |
| Muscle | 5.0e−01 | 3.7e−01 | 4.7e−01 | 1.5 | 2.1e−08 | 1.3 |
| Ovary | 1.6e−02 | 7.0e−03 | 1.5e−02 | 6.1 | 4.8e−06 | 7.1 |
| pancreas | 1.4e−01 | 5.4e−02 | 2.2e−05 | 2.9 | 2.4e−07 | 3.9 |
| prostate | 3.4e−01 | 1.9e−01 | 2.2e−01 | 1.2 | 1.4e−01 | 1.3 |
| Skin | 3.7e−01 | 1.5e−01 | 4.2e−02 | 2.4 | 1.1e−04 | 1.9 |
| stomach | 6.1e−01 | 1.4e−01 | 7.3e−01 | 0.4 | 6.1e−02 | 1.6 |
| T cells | 1 | 6.7e−01 | 1 | 1.0 | 5.2e−01 | 1.8 |
| Thyroid | 4.8e−02 | 4.8e−02 | 2.0e−01 | 3.4 | 2.0e−01 | 3.4 |
| Uterus | 2.3e−01 | 1.3e−01 | 2.2e−02 | 1.5 | 5.0e−02 | 1.4 |

As noted above, cluster T46984 features 21 transcript(s), which were listed in Table 1 above. These transcript(s) encode for protein(s) which are variant(s) of protein Dolichyl-diphosphooligosaccharide—protein glycosyltransferase 63 kDa subunit precursor. A description of each variant protein according to the present invention is now provided.

Variant protein T46984_PEA_1_P2 (SEQ ID NO: 385) according to the present invention has an amino acid sequence as given at the end of the application; it is encoded by transcript(s) T46984_PEA_1_T2 (SEQ ID NO: 314) (SEQ ID NO: 314). An alignment is given to the known protein (Dolichyl-diphosphooligosaccharide—protein glycosyltransferase 63 kDa subunit precursor) at the end of the application. One or more alignments to one or more previously published protein sequences are given at the end of the application. A brief description of the relationship of the variant protein according to the present invention to each such aligned protein is as follows:

Comparison report between T46984_PEA_1_P2 (SEQ ID NO: 385) and RIB2_HUMAN:

1. An isolated chimeric polypeptide encoding for T46984_PEA_1_P2 (SEQ ID NO: 385), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-
HVPVVVVPEGSASDTHEQAILRLQVTNVLSQ
PLTQATVKLEHAKSVASRATVLQKTSFT-
PVGDVFELNFMNVKFSSGYYDFLVEVEGDN
RYIANTVELRVKISTEVGITNVDLSTVD-
KDQSIAPKTTRVTYPAKAKGTFIADSHQNFAL
FFQLVDVNTGAELTPHQTFVRLHNQKT-
GQEVVFVAEPDNKNVYKFELDTSERKIEFDS ASG-
TYTLYLIIGDATLKNPILWNV corresponding to amino acids 1-498 of RIB2_HUMAN, which also corresponds to amino acids 1-498 of T46984_PEA__1_P2 (SEQ ID NO: 385), and a second amino acid sequence being at least 70%, optionally at least 80%, preferably at least 85%, more preferably at least 90% and most preferably at least 95% homologous to a polypeptide having the sequence VCA corresponding to amino acids 499-501 of T46984_PEA__1_P2 (SEQ ID NO: 385), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

The glycosylation sites of variant protein T46984_PEA__1_P2 (SEQ ID NO: 385), as compared to the known protein Dolichyl-diphosphooligosaccharide—protein glycosyltransferase 63 kDa subunit precursor, are described in Table 7 (given according to their position(s) on the amino acid sequence in the first column; the second column indicates whether the glycosylation site is present in the variant protein; and the last column indicates whether the position is different on the variant protein).

TABLE 7

| Glycosylation site(s) | | |
| --- | --- | --- |
| Position(s) on known amino acid sequence | Present in variant protein? | Position in variant protein? |
| 106 | yes | 106 |

Variant protein T46984_PEA__1_P2 (SEQ ID NO: 385) is encoded by the following transcript(s): T46984_PEA__1_T2 (SEQ ID NO: 314) (SEQ ID NO: 314), for which the sequence(s) is/are given at the end of the application. The coding portion of transcript T46984_PEA__1_T2 (SEQ ID NO: 314) (SEQ ID NO: 314) is shown in bold; this coding portion starts at position 316 and ends at position 1818. The transcript also has the following SNPs as listed in Table 8 (given according to their position on the nucleotide sequence, with the alternative nucleic acid listed; the last column indicates whether the SNP is known or not; the presence of known SNPs in variant protein T46984_PEA__1_P2 (SEQ ID NO: 385) sequence provides support for the deduced sequence of this variant protein according to the present invention).

TABLE 8

| Nucleic acid SNPs | | |
| --- | --- | --- |
| SNP position on nucleotide sequence | Alternative nucleic acid | Previously known SNP? |
| 28 | G -> C | No |
| 173 | G -> C | Yes |
| 256 | C -> T | Yes |
| 274 | G -> C | Yes |
| 325 | C -> | No |
| 389 | C -> G | Yes |
| 610 | G -> A | Yes |
| 718 | T -> | No |
| 724 | C -> | No |
| 844 | C -> T | Yes |
| 857 | -> G | No |
| 885 | C -> | No |
| 897 | -> G | No |
| 1002 | G -> A | No |
| 1048 | A -> | No |
| 1048 | A -> G | No |
| 1068 | A -> C | No |
| 1076 | G -> A | Yes |
| 1187 | A -> | No |
| 1187 | A -> C | No |
| 1220 | A -> G | No |
| 1220 | A -> T | No |
| 1254 | T -> G | No |
| 1291 | A -> C | No |
| 1293 | C -> G | No |
| 1303 | G -> A | No |
| 1376 | G -> T | Yes |
| 1588 | A -> C | No |
| 1618 | T -> | No |
| 1618 | T -> C | No |
| 1660 | T -> | No |
| 1693 | A -> C | No |
| 1693 | A -> T | No |
| 2099 | G -> A | Yes |
| 2124 | C -> G | Yes |
| 2124 | C -> T | Yes |
| 2133 | A -> G | Yes |
| 2501 | C -> T | Yes |
| 2617 | G -> T | Yes |
| 2683 | C -> T | Yes |
| 2741 | G -> A | Yes |
| 2940 | T -> | No |
| 3024 | G -> A | Yes |
| 3158 | C -> | No |
| 3158 | C -> A | No |
| 3165 | C -> | No |
| 3169 | G -> | No |
| 3354 | C -> A | No |
| 3374 | T -> C | Yes |
| 3468 | C -> T | No |
| 3501 | A -> C | No |
| 3513 | A -> T | No |
| 3528 | G -> A | Yes |
| 3534 | -> A | No |
| 3543 | A -> G | No |
| 3568 | T -> G | No |
| 3582 | T -> A | No |
| 3582 | T -> G | No |
| 3682 | -> C | No |
| 3691 | T -> | No |
| 3750 | A -> C | No |

Variant protein T46984_PEA__1_P3 (SEQ ID NO: 386) according to the present invention has an amino acid sequence as given at the end of the application; it is encoded by transcript(s) T46984_PEA__1_T3 (SEQ ID NO: 315). An alignment is given to the known protein (Dolichyl-diphosphooligosaccharide—protein glycosyltransferase 63 kDa subunit precursor) at the end of the application. One or more alignments to one or more previously published protein sequences are given at the end of the application. A brief description of the relationship of the variant protein according to the present invention to each such aligned protein is as follows:

Comparison report between T46984_PEA_1_P3 (SEQ ID NO: 386) and RIB2_HUMAN:

1. An isolated chimeric polypeptide encoding for T46984_PEA_1_P3 (SEQ ID NO: 386), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVELRVKISTEVGITNVDLSTVD-KDQSIAPKTTRVTYPAKAKGTFIADSHQNFAL FFQLVDVNTGAELTPHQ corresponding to amino acids 1-433 of RIB2_HUMAN, which also corresponds to amino acids 1-433 of T46984_PEA_1_P3 (SEQ ID NO: 386), and a second amino acid sequence being at least 70%, optionally at least 80%, preferably at least 85%, more preferably at least 90% and most preferably at least 95% homologous to a polypeptide having the sequence ICHIWKLIFLP (SEQ ID NO: 1061) corresponding to amino acids 434-444 of T46984_PEA_1_P3 (SEQ ID NO: 386), wherein said first amino acid sequence and second amino acid sequence are contiguous and in a sequential order.

2. An isolated polypeptide encoding for a tail of T46984_PEA_1_P3 (SEQ ID NO: 386), comprising a polypeptide being at least 70%, optionally at least about 80%, preferably at least about 85%, more preferably at least about 90% and most preferably at least about 95% homologous to the sequence ICHIWKLIFLP (SEQ ID NO: 1061) in T46984_PEA_1_P3 (SEQ ID NO: 386).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA_1_P3 (SEQ ID NO: 386) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein T46984_PEA_1_P3 (SEQ ID NO: 386) sequence provides support for the deduced sequence of this variant protein according to the present invention).

TABLE 9

Amino acid mutations

| SNP position(s) on amino acid sequence | Alternative amino acid(s) | Previously known SNP? |
|---|---|---|
| 4 | P -> | No |
| 25 | P -> R | Yes |
| 99 | G -> R | Yes |
| 135 | F -> | No |
| 137 | L -> | No |
| 190 | R -> | No |
| 245 | N -> | No |
| 245 | N -> D | No |
| 251 | E -> D | No |
| 254 | S -> N | Yes |
| 291 | Q -> | No |
| 291 | Q -> P | No |
| 302 | Q -> R | No |
| 302 | Q -> L | No |
| 326 | T -> P | No |
| 330 | D -> N | No |
| 354 | G -> V | Yes |
| 425 | T -> P | No |

The glycosylation sites of variant protein T46984_PEA_1_P3 (SEQ ID NO: 386), as compared to the known protein Dolichyl-diphosphooligosaccharide—protein glycosyltransferase 63 kDa subunit precursor, are described in Table 10 (given according to their position(s) on the amino acid sequence in the first column; the second column indicates whether the glycosylation site is present in the variant protein; and the last column indicates whether the position is different on the variant protein).

TABLE 10

Glycosylation site(s)

| Position(s) on known amino acid sequence | Present in variant protein? | Position in variant protein? |
|---|---|---|
| 106 | yes | 106 |

Variant protein T46984_PEA_1_P3 (SEQ ID NO: 386) is encoded by the following transcript(s): T46984_PEA_1_T3 (SEQ ID NO: 315), for which the sequence(s) is/are given at the end of the application. The coding portion of transcript T46984_PEA_1_T3 (SEQ ID NO: 315) is shown in bold; this coding portion starts at position 316 and ends at position 1647. The transcript also has the following SNPs as listed in Table 11 (given according to their position on the nucleotide sequence, with the alternative nucleic acid listed; the last column indicates whether the SNP is known or not; the presence of known SNPs in variant protein T46984_PEA_1_P3 (SEQ ID NO: 386) sequence provides support for the deduced sequence of this variant protein according to the present invention).

TABLE 11

Nucleic acid SNPs

| SNP position on nucleotide sequence | Alternative nucleic acid | Previously known SNP? |
|---|---|---|
| 28 | G -> C | No |
| 173 | G -> C | Yes |
| 256 | C -> T | Yes |
| 274 | G -> C | Yes |
| 325 | C -> | No |

TABLE 11-continued

Nucleic acid SNPs

| SNP position on nucleotide sequence | Alternative nucleic acid | Previously known SNP? |
|---|---|---|
| 389 | C -> G | Yes |
| 610 | G -> A | Yes |
| 718 | T -> | No |
| 724 | C -> | No |
| 844 | C -> T | Yes |
| 857 | -> G | No |
| 885 | C -> | No |
| 897 | -> G | No |
| 1002 | G -> A | No |
| 1048 | A -> | No |
| 1048 | A -> G | No |
| 1068 | A -> C | No |
| 1076 | G -> A | Yes |
| 1187 | A -> | No |
| 1187 | A -> C | No |
| 1220 | A -> G | No |
| 1220 | A -> T | No |
| 1254 | T -> G | No |
| 1291 | A -> C | No |
| 1293 | C -> G | No |
| 1303 | G -> A | No |
| 1376 | G -> T | Yes |
| 1588 | A -> C | No |
| 1784 | C -> T | Yes |
| 1959 | G -> A | Yes |
| 2112 | G -> A | Yes |
| 2137 | C -> G | Yes |
| 2246 | T -> | No |
| 2246 | T -> C | No |
| 2288 | T -> | No |
| 2321 | A -> C | No |
| 2321 | A -> T | No |
| 2552 | C -> | No |
| 2552 | C -> A | No |
| 2559 | C -> | No |
| 2563 | G -> | No |
| 2748 | C -> A | No |
| 2768 | T -> C | Yes |
| 2862 | C -> T | No |
| 2895 | A -> C | No |
| 2907 | A -> T | No |
| 2922 | G -> A | Yes |
| 2928 | -> A | No |
| 2937 | A -> G | No |
| 2962 | T -> G | No |
| 2976 | T -> A | No |
| 2976 | T -> G | No |
| 3076 | -> C | No |
| 3085 | T -> | No |
| 3144 | A -> C | No |

Variant protein T46984_PEA_1_P10 (SEQ ID NO: 387) according to the present invention has an amino acid sequence as given at the end of the application; it is encoded by transcript(s) T46984_PEA_1_T13 (SEQ ID NO: 317). An alignment is given to the known protein (Dolichyl-diphosphooligosaccharide—protein glycosyltransferase 63 kDa subunit precursor) at the end of the application. One or more alignments to one or more previously published protein sequences are given at the end of the application. A brief description of the relationship of the variant protein according to the present invention to each such aligned protein is as follows:

Comparison report between T46984_PEA_1_P10 (SEQ ID NO: 387) and RIB2_HUMAN:

1. An isolated chimeric polypeptide encoding for T46984_PEA_1_P10 (SEQ ID NO: 387), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVELRVKISTEVGITNVDLSTVD-KDQSIAPKTTRVTYPAKAKGTFIADSHQNFAL FFQLVDVNTGAELTPHQTFVRLHNQKT-GQEVVFVAEPDNKNVYKFELDTSERKIEFDS ASG-TYTLYLIIGDATLKNPILWNV corresponding to amino acids 1-498 of RIB2_HUMAN, which also corresponds to amino acids 1-498 of T46984_PEA_1_P10 (SEQ ID NO: 387), and a second amino acid sequence being at least 70%, optionally at least 80%, preferably at least 85%, more preferably at least 90% and most preferably at least 95% homologous to a polypeptide having the sequence LMDQK (SEQ ID NO: 1062) corresponding to amino acids 499-503 of T46984_PEA_1_P10 (SEQ ID NO: 387), wherein said first amino acid sequence and second amino acid sequence are contiguous and in a sequential order.

2. An isolated polypeptide encoding for a tail of T46984_PEA_1_P10 (SEQ ID NO: 387), comprising a polypeptide being at least 70%, optionally at least about 80%, preferably at least about 85%, more preferably at least about 90% and most preferably at least about 95% homologous to the sequence LMDQK (SEQ ID NO: 1062) in T46984_PEA_1_P10 (SEQ ID NO: 387).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA_1_P10 (SEQ ID NO: 387) also has the following non-silent SNPs (Single Nucleotide Polymorphisms) as listed in Table 12, (given according to their position(s) on the amino acid sequence, with the alternative amino acid(s) listed; the last column indicates whether the SNP is known or not; the presence of known SNPs in variant protein T46984_PEA_1_P10 (SEQ ID NO: 387) sequence provides support for the deduced sequence of this variant protein according to the present invention).

TABLE 12

Amino acid mutations

| SNP position(s) on amino acid sequence | Alternative amino acid(s) | Previously known SNP? |
|---|---|---|
| 4 | P -> | No |
| 25 | P -> R | Yes |
| 99 | G -> R | Yes |
| 135 | F -> | No |
| 137 | L -> | No |
| 190 | R -> | No |
| 245 | N -> | No |
| 245 | N -> D | No |
| 251 | E -> D | No |

TABLE 12-continued

Amino acid mutations

| SNP position(s) on amino acid sequence | Alternative amino acid(s) | Previously known SNP? |
|---|---|---|
| 254 | S -> N | Yes |
| 291 | Q -> | No |
| 291 | Q -> P | No |
| 302 | Q -> R | No |
| 302 | Q -> L | No |
| 326 | T -> P | No |
| 330 | D -> N | No |
| 354 | G -> V | Yes |
| 425 | T -> P | No |
| 435 | F -> | No |
| 435 | F -> L | No |
| 449 | F -> | No |
| 460 | K -> * | No |
| 460 | K -> Q | No |

The glycosylation sites of variant protein T46984_PEA_1_P10 (SEQ ID NO: 387), as compared to the known protein Dolichyl-diphosphooligosaccharide—protein glycosyltransferase 63 kDa subunit precursor, are described in Table 13 (given according to their position(s) on the amino acid sequence in the first column; the second column indicates whether the glycosylation site is present in the variant protein; and the last column indicates whether the position is different on the variant protein).

TABLE 13

Glycosylation site(s)

| Position(s) on known amino acid sequence | Present in variant protein? | Position in variant protein? |
|---|---|---|
| 106 | yes | 106 |

Variant protein T46984_PEA_1_P10 (SEQ ID NO: 387) is encoded by the following transcript(s): T46984_PEA_1_T13 (SEQ ID NO: 317), for which the sequence(s) is/are given at the end of the application. The coding portion of transcript T46984_PEA_1_T13 (SEQ ID NO: 317) is shown in bold; this coding portion starts at position 316 and ends at position 1824. The transcript also has the following SNPs as listed in Table 14 (given according to their position on the nucleotide sequence, with the alternative nucleic acid listed; the last column indicates whether the SNP is known or not; the presence of known SNPs in variant protein T46984_PEA_1_P10 (SEQ ID NO: 387) sequence provides support for the deduced sequence of this variant protein according to the present invention).

TABLE 14

Nucleic acid SNPs

| SNP position on nucleotide sequence | Alternative nucleic acid | Previously known SNP? |
|---|---|---|
| 28 | G -> C | No |
| 173 | G -> C | Yes |
| 256 | C -> T | Yes |
| 274 | G -> C | Yes |
| 325 | C -> | No |
| 389 | C -> G | Yes |
| 610 | G -> A | Yes |
| 718 | T -> | No |
| 724 | C -> | No |
| 844 | C -> T | Yes |
| 857 | -> G | No |
| 885 | C -> | No |
| 897 | -> G | No |
| 1002 | G -> A | No |
| 1048 | A -> | No |
| 1048 | A -> G | No |
| 1068 | A -> C | No |
| 1076 | G -> A | Yes |
| 1187 | A -> | No |
| 1187 | A -> C | No |
| 1220 | A -> G | No |
| 1220 | A -> T | No |
| 1254 | T -> G | No |
| 1291 | A -> C | No |
| 1293 | C -> G | No |
| 1303 | G -> A | No |
| 1376 | G -> T | Yes |
| 1588 | A -> C | No |
| 1618 | T -> | No |
| 1618 | T -> C | No |
| 1660 | T -> | No |
| 1693 | A -> C | No |
| 1693 | A -> T | No |
| 1845 | T -> | No |
| 1983 | C -> | No |
| 1983 | C -> A | No |
| 1990 | C -> | No |
| 1994 | G -> | No |
| 2179 | C -> A | No |
| 2199 | T -> C | Yes |
| 2293 | C -> T | No |
| 2326 | A -> C | No |
| 2338 | A -> T | No |
| 2353 | G -> A | Yes |
| 2359 | -> A | No |
| 2368 | A -> G | No |
| 2393 | T -> G | No |
| 2407 | T -> A | No |
| 2407 | T -> G | No |
| 2507 | -> C | No |
| 2516 | T -> | No |
| 2575 | A -> C | No |

Variant protein T46984_PEA_1_P11 (SEQ ID NO: 388) according to the present invention has an amino acid sequence as given at the end of the application; it is encoded by transcript(s) T46984_PEA_1_T14 (SEQ ID NO: 318). An alignment is given to the known protein (Dolichyl-diphosphooligosaccharide—protein glycosyltransferase 63 kDa subunit precursor) at the end of the application. One or more alignments to one or more previously published protein sequences are given at the end of the application. A brief description of the relationship of the variant protein according to the present invention to each such aligned protein is as follows:

Comparison report between T46984_PEA_1_P11 (SEQ ID NO: 388) and RIB2_HUMAN:

1. An isolated chimeric polypeptide encoding for T46984_PEA_1_P11 (SEQ ID NO: 388), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET- TALFVAATYKLMDHVGTEPSIKEDQVIQLMNA
IFSKKNFESLSEAFSVASAAAVLSHNRY-
HVPVVVVPEGSASDTHEQAILRLQVTNVLSQ
PLTQATVKLEHAKSVASRATVLQKTSFT-
PVGDVFELNFMNVKFSSGYYDFLVEVEGDN
RYIANTVELRVKISTEVGITNVDLSTVD-
KDQSIAPKTTRVTYPAKAKGTFIADSHQNFAL
FFQLVDVNTGAELTPHQTFVRLHNQKT-
GQEVVFVAEPDNKNVYKFELDTSERKIEFDS ASG-
TYTLYLIIGDATLKNPILWNVADVVIKF-
PEEEAPSTVLSQNLFTPKQEIQHLFREPEK
RPPTVVSNTFTALILSPLLLLFAL-
WIRIGANVSNFTFAPSTIIFHLGHAAMLGLMYVYWT
QLNMFQTLKYLAILGSVTFLAGNRMLAQQAVKR corresponding to amino acids 1-628 of RIB2_HUMAN, which also corresponds to amino acids 1-628 of T46984_PEA__1_P11 (SEQ ID NO: 388).

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a trans-membrane region downstream of this signal peptide.

Variant protein T46984_PEA__1_P11 (SEQ ID NO: 388) also has the following non-silent SNPs (Single Nucleotide Polymorphisms) as listed in Table 15, (given according to their position(s) on the amino acid sequence, with the alternative amino acid(s) listed; the last column indicates whether the SNP is known or not; the presence of known SNPs in variant protein T46984_PEA__1_P11 (SEQ ID NO: 388) sequence provides support for the deduced sequence of this variant protein according to the present invention).

TABLE 15

Amino acid mutations

| SNP position(s) on amino acid sequence | Alternative amino acid(s) | Previously known SNP? |
|---|---|---|
| 4 | P -> | No |
| 25 | P -> R | Yes |
| 99 | G -> R | Yes |
| 135 | F -> | No |
| 137 | L -> | No |
| 190 | R -> | No |
| 245 | N -> | No |
| 245 | N -> D | No |
| 251 | E -> D | No |
| 254 | S -> N | Yes |
| 291 | Q -> P | No |
| 291 | Q -> | No |
| 302 | Q -> L | No |
| 302 | Q -> R | No |
| 326 | T -> P | No |
| 330 | D -> N | No |
| 354 | G -> V | Yes |
| 425 | T -> P | No |
| 435 | F -> | No |
| 435 | F -> L | No |
| 449 | F -> | No |
| 460 | K -> Q | No |
| 460 | K -> * | No |
| 537 | P -> T | No |
| 537 | P -> | No |
| 539 | T -> | No |
| 540 | V -> | No |
| 602 | T -> N | No |

The glycosylation sites of variant protein T46984_PEA__1_P11 (SEQ ID NO: 388), as compared to the known protein Dolichyl-diphosphooligosaccharide—protein glycosyltransferase 63 kDa subunit precursor, are described in Table 16 (given according to their position(s) on the amino acid sequence in the first column; the second column indicates whether the glycosylation site is present in the variant protein; and the last column indicates whether the position is different on the variant protein).

TABLE 16

Glycosylation site(s)

| Position(s) on known amino acid sequence | Present in variant protein? | Position in variant protein? |
|---|---|---|
| 106 | yes | 106 |

Variant protein T46984_PEA__1_P11 (SEQ ID NO: 388) is encoded by the following transcript(s): T46984_PEA__1_T14 (SEQ ID NO: 318), for which the sequence(s) is/are given at the end of the application. The coding portion of transcript T46984_PEA__1_T14 (SEQ ID NO: 318) is shown in bold; this coding portion starts at position 316 and ends at position 2199. The transcript also has the following SNPs as listed in Table 17 (given according to their position on the nucleotide sequence, with the alternative nucleic acid listed; the last column indicates whether the SNP is known or not; the presence of known SNPs in variant protein T46984_PEA__1_P11 (SEQ ID NO: 388) sequence provides support for the deduced sequence of this variant protein according to the present invention).

TABLE 17

Nucleic acid SNPs

| SNP position on nucleotide sequence | Alternative nucleic acid | Previously known SNP? |
|---|---|---|
| 28 | G -> C | No |
| 173 | G -> C | Yes |
| 256 | C -> T | Yes |
| 274 | G -> C | Yes |
| 325 | C -> | No |
| 389 | C -> G | Yes |
| 610 | G -> A | Yes |
| 718 | T -> | No |
| 724 | C -> | No |
| 844 | C -> T | Yes |
| 857 | -> G | No |
| 885 | C -> | No |
| 897 | -> G | No |
| 1002 | G -> A | No |
| 1048 | A -> | No |
| 1048 | A -> G | No |
| 1068 | A -> C | No |
| 1076 | G -> A | Yes |
| 1187 | A -> | No |
| 1187 | A -> C | No |
| 1220 | A -> G | No |
| 1220 | A -> T | No |
| 1254 | T -> G | No |
| 1291 | A -> C | No |
| 1293 | C -> G | No |
| 1303 | G -> A | No |
| 1376 | G -> T | Yes |
| 1588 | A -> C | No |
| 1618 | T -> | No |
| 1618 | T -> C | No |
| 1660 | T -> | No |
| 1693 | A -> C | No |
| 1693 | A -> T | No |
| 1924 | C -> | No |

TABLE 17-continued

Nucleic acid SNPs

| SNP position on nucleotide sequence | Alternative nucleic acid | Previously known SNP? |
|---|---|---|
| 1924 | C -> A | No |
| 1931 | C -> | No |
| 1935 | G -> | No |
| 2120 | C -> A | No |
| 2140 | T -> C | Yes |
| 2449 | A -> | Yes |
| 2537 | C -> T | Yes |
| 2614 | C -> T | Yes |
| 2699 | C -> T | Yes |
| 2857 | G -> A | Yes |
| 2879 | A -> G | Yes |
| 3078 | A -> G | Yes |
| 3354 | G -> A | Yes |

Variant protein T46984_PEA_1_P12 (SEQ ID NO: 389) according to the present invention has an amino acid sequence as given at the end of the application; it is encoded by transcript(s) T46984_PEA_1_T15 (SEQ ID NO: 319). An alignment is given to the known protein (Dolichyl-diphosphooligosaccharide—protein glycosyltransferase 63 kDa subunit precursor) at the end of the application. One or more alignments to one or more previously published protein sequences are given at the end of the application. A brief description of the relationship of the variant protein according to the present invention to each such aligned protein is as follows:

Comparison report between T46984_PEA_1_P12 (SEQ ID NO: 389) and RIB2_HUMAN:

1. An isolated chimeric polypeptide encoding for T46984_PEA_1_P12 (SEQ ID NO: 389), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMN corresponding to amino acids 1-338 of RIB2_HUMAN, which also corresponds to amino acids 1-338 of T46984_PEA_1_P12 (SEQ ID NO: 389), and a second amino acid sequence being at least 70%, optionally at least 80%, preferably at least 85%, more preferably at least 90% and most preferably at least 95% homologous to a polypeptide having the sequence SQDLH (SEQ ID NO: 1063) corresponding to amino acids 339-343 of T46984_PEA_1_P12 (SEQ ID NO: 389), wherein said first amino acid sequence and second amino acid sequence are contiguous and in a sequential order.

2. An isolated polypeptide encoding for a tail of T46984_PEA_1_P12 (SEQ ID NO: 389), comprising a polypeptide being at least 70%, optionally at least about 80%, preferably at least about 85%, more preferably at least about 90% and most preferably at least about 95% homologous to the sequence SQDLH (SEQ ID NO: 1063) in T46984_PEA_1_P12 (SEQ ID NO: 389).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA_1_P12 (SEQ ID NO: 389) also has the following non-silent SNPs (Single Nucleotide Polymorphisms) as listed in Table 18, (given according to their position(s) on the amino acid sequence, with the alternative amino acid(s) listed; the last column indicates whether the SNP is known or not; the presence of known SNPs in variant protein T46984_PEA_1_P12 (SEQ ID NO: 389) sequence provides support for the deduced sequence of this variant protein according to the present invention).

TABLE 18

Amino acid mutations

| SNP position(s) on amino acid sequence | Alternative amino acid(s) | Previously known SNP? |
|---|---|---|
| 4 | P -> | No |
| 25 | P -> R | Yes |
| 99 | G -> R | Yes |
| 135 | F -> | No |
| 137 | L -> | No |
| 190 | R -> | No |
| 245 | N -> | No |
| 245 | N -> D | No |
| 251 | E -> D | No |
| 254 | S -> N | Yes |
| 291 | Q -> | No |
| 291 | Q -> P | No |
| 302 | Q -> L | No |
| 302 | Q -> R | No |
| 326 | T -> P | No |
| 330 | D -> N | No |

The glycosylation sites of variant protein T46984_PEA_1_P12 (SEQ ID NO: 389), as compared to the known protein Dolichyl-diphosphooligosaccharide—protein glycosyltransferase 63 kDa subunit precursor, are described in Table 19 (given according to their position(s) on the amino acid sequence in the first column; the second column indicates whether the glycosylation site is present in the variant protein; and the last column indicates whether the position is different on the variant protein).

TABLE 19

Glycosylation site(s)

| Position(s) on known amino acid sequence | Present in variant protein? | Position in variant protein? |
|---|---|---|
| 106 | yes | 106 |

Variant protein T46984_PEA_1_P12 (SEQ ID NO: 389) is encoded by the following transcript(s): T46984_PEA_1_T15 (SEQ ID NO: 319), for which the sequence(s) is/are given at the end of the application. The coding portion of transcript T46984_PEA_1_T15 (SEQ ID NO: 319) is shown in bold; this coding portion starts at position 316 and ends at position 1344. The transcript also has the following SNPs as listed in Table 20 (given according to their position on the nucleotide sequence, with the alternative nucleic acid listed; the last column indicates whether the SNP is known or not; the presence of known SNPs in variant protein T46984_PEA_1_P12 (SEQ ID NO: 389) sequence provides support for the deduced sequence of this variant protein according to the present invention).

TABLE 20

Nucleic acid SNPs

| SNP position on nucleotide sequence | Alternative nucleic acid | Previously known SNP? |
|---|---|---|
| 28 | G -> C | No |
| 173 | G -> C | Yes |
| 256 | C -> T | Yes |
| 274 | G -> C | Yes |
| 325 | C -> | No |
| 389 | C -> G | Yes |
| 610 | G -> A | Yes |
| 718 | T -> | No |
| 724 | C -> | No |
| 844 | C -> T | Yes |
| 857 | -> G | No |
| 885 | C -> | No |
| 897 | -> G | No |
| 1002 | G -> A | No |
| 1048 | A -> | No |
| 1048 | A -> G | No |
| 1068 | A -> C | No |
| 1076 | G -> A | Yes |
| 1187 | A -> | No |
| 1187 | A -> C | No |
| 1220 | A -> G | No |
| 1220 | A -> T | No |
| 1254 | T -> G | No |
| 1291 | A -> C | No |
| 1293 | C -> G | No |
| 1303 | G -> A | No |
| 1505 | A -> C | No |
| 1535 | T -> | No |
| 1535 | T -> C | No |
| 1577 | T -> | No |
| 1610 | A -> C | No |
| 1610 | A -> T | No |
| 1841 | C -> | No |
| 1841 | C -> A | No |
| 1848 | C -> | No |
| 1852 | G -> | No |
| 2037 | C -> A | No |
| 2057 | T -> C | Yes |
| 2151 | C -> T | No |
| 2184 | A -> C | No |
| 2196 | A -> T | No |
| 2211 | G -> A | Yes |
| 2217 | -> A | No |
| 2226 | A -> G | No |
| 2251 | T -> G | No |
| 2265 | T -> A | No |
| 2265 | T -> G | No |
| 2365 | -> C | No |
| 2374 | T -> | No |
| 2433 | A -> C | No |

Variant protein T46984_PEA_1_P21 (SEQ ID NO. 390 according to the present invention has an amino acid sequence as given at the end of the application; it is encoded by transcript(s) T46984_PEA_1_T27 (SEQ ID NO: 322). An alignment is given to the known protein (Dolichyl-diphosphooligosaccharide—protein glycosyltransferase 63 kDa subunit precursor) at the end of the application. One or more alignments to one or more previously published protein sequences are given at the end of the application. A brief description of the relationship of the variant protein according to the present invention to each such aligned protein is as follows:

Comparison report between T46984_PEA_1_P21 (SEQ ID NO. 390 and RIB2_HUMAN:

1. An isolated chimeric polypeptide encoding for T46984_PEA_1_P21 (SEQ ID NO. 390, comprising a first amino acid sequence being at least 70%, optionally at least 80%, preferably at least 85%, more preferably at least 90% and most preferably at least 95% homologous to a polypeptide having the sequence M corresponding to amino acids 1-1 of T46984_PEA_1_P21 (SEQ ID NO. 390, and a second amino acid sequence being at least 90% homologous to KAC-TYIRSNLDPSNVDSLFYAAQASQALSG-CEISISNETKDLLLAAVSEDSSVTQIYHAV AALSGF-GLPLASQEALSALTARLSKEETVLATVQALQTASHLS QQADLRSIVEEIEDLVA RLDELGGVYLQFEEGLET-TALFVAATYKLMDH-VGTEPSIKEDQVIQLMNAIFSKKNFES LSEAFS-VASAAAVLSHNRYHVPVVVVPEGSASDTHEQAILRL QVTNVLSQPLTQATVKL EHAKSVASRATVLQKTSFT-PVGDVFELNFMNVKFSSGYYD-FLVEVEGDNRYIANTVEL RVKISTEVGITNVDLSTVD-KDQSIAPKTTRVTYPAKAKGTFIADSHQNFALFFQLV DVNT GAELTPHQTFVRLHNQKTGQEVVFVAEP-DNKNVYKFELDTSERKIEFDSASGTYTLYLII GDATLKNPILWNVADVVIKFPEEEAP-STVLSQNLFTPKQEIQHLFREPEKRPPTVVSNTF TALILSPLLLLFALWIRIGANVSNFT-FAPSTIIFHLGHAAMLGLMYVYWTQLNMFQTLKY LAILGSVTFLAGNRMLAQQAVKRTAH corresponding to amino acids 70-631 of RIB2_HUMAN, which also corresponds to amino acids 2-563 of T46984_PEA_1_P21 (SEQ ID NO. 390, wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: membrane. The protein localization is believed to be membrane because both trans-membrane region prediction programs predicted a trans-membrane region for this protein. In addition both signal-peptide prediction programs predict that this protein is a non-secreted protein.

Variant protein T46984_PEA_1_P21 (SEQ ID NO. 390 also has the following non-silent SNPs (Single Nucleotide Polymorphisms) as listed in Table 21, (given according to their position(s) on the amino acid sequence, with the alternative amino acid(s) listed; the last column indicates whether the SNP is known or not; the presence of known SNPs in variant protein T46984_PEA_1_P21 (SEQ ID NO. 390 sequence provides support for the deduced sequence of this variant protein according to the present invention).

TABLE 21

Amino acid mutations

| SNP position(s) on amino acid sequence | Alternative amino acid(s) | Previously known SNP? |
|---|---|---|
| 31 | G -> R | Yes |
| 67 | F -> | No |
| 69 | L -> | No |
| 122 | R -> | No |
| 177 | N -> | No |
| 177 | N -> D | No |
| 183 | E -> D | No |
| 186 | S -> N | Yes |
| 223 | Q -> P | No |
| 223 | Q -> | No |
| 234 | Q -> L | No |

TABLE 21-continued

Amino acid mutations

| SNP position(s) on amino acid sequence | Alternative amino acid(s) | Previously known SNP? |
|---|---|---|
| 234 | Q -> R | No |
| 258 | T -> P | No |
| 262 | D -> N | No |
| 286 | G -> V | Yes |
| 357 | T -> P | No |
| 367 | F -> L | No |
| 367 | F -> | No |
| 381 | F -> | No |
| 392 | K -> * | No |
| 392 | K -> Q | No |
| 469 | P -> | No |
| 469 | P -> T | No |
| 471 | T -> | No |
| 472 | V -> | No |
| 534 | T -> N | No |

The glycosylation sites of variant protein T46984_PEA_1_P21 (SEQ ID NO. 390, as compared to the known protein Dolichyl-diphosphooligosaccharide—protein glycosyltransferase 63 kDa subunit precursor, are described in Table 22 (given according to their position(s) on the amino acid sequence in the first column; the second column indicates whether the glycosylation site is present in the variant protein; and the last column indicates whether the position is different on the variant protein).

TABLE 22

Glycosylation site(s)

| Position(s) on known amino acid sequence | Present in variant protein? | Position in variant protein? |
|---|---|---|
| 106 | yes | 38 |

Variant protein T46984_PEA_1_P21 (SEQ ID NO. 390 is encoded by the following transcript(s): T46984_PEA_1_T27 (SEQ ID NO: 322), for which the sequence(s) is/are given at the end of the application. The coding portion of transcript T46984_PEA_1_T27 (SEQ ID NO: 322) is shown in bold; this coding portion starts at position 338 and ends at position 2026. The transcript also has the following SNPs as listed in Table 23 (given according to their position on the nucleotide sequence, with the alternative nucleic acid listed; the last column indicates whether the SNP is known or not; the presence of known SNPs in variant protein T46984_PEA_1_P21 (SEQ ID NO. 390 sequence provides support for the deduced sequence of this variant protein according to the present invention).

TABLE 23

Nucleic acid SNPs

| SNP position on nucleotide sequence | Alternative nucleic acid | Previously known SNP? |
|---|---|---|
| 68 | C -> T | Yes |
| 194 | A -> G | Yes |
| 428 | G -> A | Yes |
| 536 | T -> | No |
| 542 | C -> | No |
| 662 | C -> T | Yes |
| 675 | -> G | No |
| 703 | C -> | No |

TABLE 23-continued

Nucleic acid SNPs

| SNP position on nucleotide sequence | Alternative nucleic acid | Previously known SNP? |
|---|---|---|
| 715 | -> G | No |
| 820 | G -> A | No |
| 866 | A -> | No |
| 866 | A -> G | No |
| 886 | A -> C | No |
| 894 | G -> A | Yes |
| 1005 | A -> | No |
| 1005 | A -> C | No |
| 1038 | A -> G | No |
| 1038 | A -> T | No |
| 1072 | T -> G | No |
| 1109 | A -> C | No |
| 1111 | C -> G | No |
| 1121 | G -> A | No |
| 1194 | G -> T | Yes |
| 1406 | A -> C | No |
| 1436 | T -> | No |
| 1436 | T -> C | No |
| 1478 | T -> | No |
| 1511 | A -> C | No |
| 1511 | A -> T | No |
| 1742 | C -> | No |
| 1742 | C -> A | No |
| 1749 | C -> | No |
| 1753 | G -> | No |
| 1938 | C -> A | No |
| 1958 | T -> C | Yes |
| 2052 | C -> T | No |
| 2085 | A -> C | No |
| 2097 | A -> T | No |
| 2112 | G -> A | Yes |
| 2118 | -> A | No |
| 2127 | A -> G | No |
| 2152 | T -> G | No |
| 2166 | T -> A | No |
| 2166 | T -> G | No |
| 2266 | -> C | No |
| 2275 | T -> | No |
| 2334 | A -> C | No |

Variant protein T46984_PEA_1_P27 (SEQ ID NO: 391) according to the present invention has an amino acid sequence as given at the end of the application; it is encoded by transcript(s) T46984_PEA_1_T34 (SEQ ID NO: 324). An alignment is given to the known protein (Dolichyl-diphosphooligosaccharide—protein glycosyltransferase 63 kDa subunit precursor) at the end of the application. One or more alignments to one or more previously published protein sequences are given at the end of the application. A brief description of the relationship of the variant protein according to the present invention to each such aligned protein is as follows:

Comparison report between T46984_PEA_1_P27 (SEQ ID NO: 391) and RIB2_HUMAN:

1. An isolated chimeric polypeptide encoding for T46984_PEA_1_P27 (SEQ ID NO: 391), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-
PVGDVFELNFMNVKFSSGYYDFLVEVEGDN
RYIANTVELRVKISTEVGITNVDLSTVD-
KDQSIAPKTTRVTYPAKAKGTFIADSHQNFA corresponding to amino acids 1-415 of RIB2_HUMAN, which also corresponds to amino acids 1-415 of T46984_PEA_1_P27 (SEQ ID NO: 391), and a second amino acid sequence being at least 70%, optionally at least 80%, preferably at least 85%, more preferably at least 90% and most preferably at least 95% homologous to a polypeptide having the sequence FGSGLVPMSPTSLLLLARLYFTWDM-
LLCWDSCMSTGLSSTCSRP (SEQ ID NO: 1064) corresponding to amino acids 416-459 of T46984_PEA_1_P27 (SEQ ID NO: 391), wherein said first amino acid sequence and second amino acid sequence are contiguous and in a sequential order.

2. An isolated polypeptide encoding for a tail of T46984_PEA_1_P27 (SEQ ID NO: 391), comprising a polypeptide being at least 70%, optionally at least about 80%, preferably at least about 85%, more preferably at least about 90% and most preferably at least about 95% homologous to the sequence FGSGLVPMSPTSLLLLARLYFTWDM-
LLCWDSCMSTGLSSTCSRP (SEQ ID NO: 1064) in T46984_PEA_1_P27 (SEQ ID NO: 391).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA_1_P27 (SEQ ID NO: 391) also has the following non-silent SNPs (Single Nucleotide Polymorphisms) as listed in Table 24, (given according to their position(s) on the amino acid sequence, with the alternative amino acid(s) listed; the last column indicates whether the SNP is known or not; the presence of known SNPs in variant protein T46984_PEA_1_P27 (SEQ ID NO: 391) sequence provides support for the deduced sequence of this variant protein according to the present invention).

TABLE 24

Amino acid mutations

| SNP position(s) on amino acid sequence | Alternative amino acid(s) | Previous know SNP? |
|---|---|---|
| 4 | P -> | No |
| 25 | P -> R | Yes |
| 99 | G -> R | Yes |
| 135 | F -> | No |
| 137 | L -> | No |
| 190 | R -> | No |
| 245 | N -> | No |
| 245 | N -> D | No |
| 251 | E -> D | No |
| 254 | S -> N | Yes |
| 291 | Q -> | No |
| 291 | Q -> P | No |
| 302 | Q -> R | No |
| 302 | Q -> L | No |
| 326 | T -> P | No |
| 330 | D -> N | No |
| 354 | G -> V | Yes |
| 459 | P -> T | No |

The glycosylation sites of variant protein T46984_PEA_1_P27 (SEQ ID NO: 391), as compared to the known protein Dolichyl-diphosphooligosaccharide—protein glycosyltransferase 63 kDa subunit precursor, are described in Table 25 (given according to their position(s) on the amino acid sequence in the first column; the second column indicates whether the glycosylation site is present in the variant protein; and the last column indicates whether the position is different on the variant protein).

TABLE 25

Glycosylation site(s)

| Position(s) on known amino acid sequence | Present in variant protein? | Position in variant protein? |
|---|---|---|
| 106 | yes | 106 |

Variant protein T46984_PEA_1_P27 (SEQ ID NO: 391) is encoded by the following transcript(s): T46984_PEA_1_T34 (SEQ ID NO: 324), for which the sequence(s) is/are given at the end of the application. The coding portion of transcript T46984_PEA_1_T34 (SEQ ID NO: 324) is shown in bold; this coding portion starts at position 316 and ends at position 1692. The transcript also has the following SNPs as listed in Table 26 (given according to their position on the nucleotide sequence, with the alternative nucleic acid listed; the last column indicates whether the SNP is known or not; the presence of known SNPs in variant protein T46984_PEA_1_P27 (SEQ ID NO: 391) sequence provides support for the deduced sequence of this variant protein according to the present invention).

TABLE 26

Nucleic acid SNPs

| SNP position on nucleotide sequence | Alternative nucleic acid | Previously known SNP? |
|---|---|---|
| 28 | G -> C | No |
| 173 | G -> C | Yes |
| 256 | C -> T | Yes |
| 274 | G -> C | Yes |
| 325 | C -> | No |
| 389 | C -> G | Yes |
| 610 | G -> A | Yes |
| 718 | T -> | No |
| 724 | C -> | No |
| 844 | C -> T | Yes |
| 857 | -> G | No |
| 885 | C -> | No |
| 897 | -> G | No |
| 1002 | G -> A | No |
| 1048 | A -> | No |
| 1048 | A -> G | No |
| 1068 | A -> C | No |
| 1076 | G -> A | Yes |
| 1187 | A -> | No |
| 1187 | A -> C | No |
| 1220 | A -> G | No |
| 1220 | A -> T | No |
| 1254 | T -> G | No |
| 1291 | A -> C | No |
| 1293 | C -> G | No |
| 1303 | G -> A | No |
| 1376 | G -> T | Yes |
| 1690 | C -> A | No |
| 1710 | T -> C | Yes |
| 1804 | C -> T | No |
| 1837 | A -> C | No |
| 1849 | A -> T | No |
| 1864 | G -> A | Yes |
| 1870 | -> A | No |

TABLE 26-continued

Nucleic acid SNPs

| SNP position on nucleotide sequence | Alternative nucleic acid | Previously known SNP? |
|---|---|---|
| 1879 | A -> G | No |
| 1904 | T -> G | No |
| 1918 | T -> A | No |
| 1918 | T -> G | No |
| 2018 | -> C | No |
| 2027 | T -> | No |
| 2086 | A -> C | No |

Variant protein T46984_PEA_1_P32 (SEQ ID NO: 392) according to the present invention has an amino acid sequence as given at the end of the application; it is encoded by transcript(s) T46984_PEA_1_T40 (SEQ ID NO: 326). An alignment is given to the known protein (Dolichyl-diphosphooligosaccharide—protein glycosyltransferase 63 kDa subunit precursor) at the end of the application. One or more alignments to one or more previously published protein sequences are given at the end of the application. A brief description of the relationship of the variant protein according to the present invention to each such aligned protein is as follows:

Comparison report between T46984_PEA_1_P32 (SEQ ID NO: 392) and RIB2_HUMAN:

1. An isolated chimeric polypeptide encoding for T46984_PEA_1_P32 (SEQ ID NO: 392), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVE corresponding to amino acids 1-364 of RIB2_HUMAN, which also corresponds to amino acids 1-364 of T46984_PEA_1_P32 (SEQ ID NO: 392), and a second amino acid sequence being at least 70%, optionally at least 80%, preferably at least 85%, more preferably at least 90% and most preferably at least 95% homologous to a polypeptide having the sequence GQVRWLTPVIPAL-WEAKAGGSPEVRSSILAWPT (SEQ ID NO: 1065) corresponding to amino acids 365-397 of T46984_PEA_1_P32 (SEQ ID NO: 392), wherein said first amino acid sequence and second amino acid sequence are contiguous and in a sequential order.

2. An isolated polypeptide encoding for a tail of T46984_PEA_1_P32 (SEQ ID NO: 392), comprising a polypeptide being at least 70%, optionally at least about 80%, preferably at least about 85%, more preferably at least about 90% and most preferably at least about 95% homologous to the sequence GQVRWLTPVIPALWEAKAGGSPEVRSSI-LAWPT (SEQ ID NO: 1065) in T46984_PEA_1_P32 (SEQ ID NO: 392).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA_1_P32 (SEQ ID NO: 392) also has the following non-silent SNPs (Single Nucleotide Polymorphisms) as listed in Table 27, (given according to their position(s) on the amino acid sequence, with the alternative amino acid(s) listed; the last column indicates whether the SNP is known or not; the presence of known SNPs in variant protein T46984_PEA_1_P32 (SEQ ID NO: 392) sequence provides support for the deduced sequence of this variant protein according to the present invention).

TABLE 27

Amino acid mutations

| SNP position(s) on amino acid sequence | Alternative amino acid(s) | Previously known SNP? |
|---|---|---|
| 4 | P -> | No |
| 25 | P -> R | Yes |
| 99 | G -> R | Yes |
| 135 | F -> | No |
| 137 | L -> | No |
| 190 | R -> | No |
| 245 | N -> | No |
| 245 | N -> D | No |
| 251 | E -> D | No |
| 254 | S -> N | Yes |
| 291 | Q -> | No |
| 291 | Q -> P | No |
| 302 | Q -> R | No |
| 302 | Q -> L | No |
| 326 | T -> P | No |
| 330 | D -> N | No |
| 354 | G -> V | Yes |

The glycosylation sites of variant protein T46984_PEA_1_P32 (SEQ ID NO: 392), as compared to the known protein Dolichyl-diphosphooligosaccharide—protein glycosyltransferase 63 kDa subunit precursor, are described in Table 28 (given according to their position(s) on the amino acid sequence in the first column; the second column indicates whether the glycosylation site is present in the variant protein; and the last column indicates whether the position is different on the variant protein).

TABLE 28

Glycosylation site(s)

| Position(s) on known amino acid sequence | Present in variant protein? | Position in variant protein? |
|---|---|---|
| 106 | yes | 106 |

Variant protein T46984_PEA_1_P32 (SEQ ID NO: 392) is encoded by the following transcript(s): T46984_PEA_1_T40 (SEQ ID NO: 326), for which the sequence(s) is/are given at the end of the application. The coding portion of transcript T46984_PEA_1_T40 (SEQ ID NO: 326) is shown in bold; this coding portion starts at position 316 and ends at position 1506. The transcript also has the following SNPs as listed in Table 29 (given according to their position on the nucleotide sequence, with the alternative nucleic acid listed; the last column indicates whether the SNP is known or not; the presence of known SNPs in variant protein T46984_PEA_1_P32 (SEQ ID NO: 392) sequence provides support for the deduced sequence of this variant protein according to the present invention).

TABLE 29

Nucleic acid SNPs

| SNP position on nucleotide sequence | Alternative nucleic acid | Previously known SNP? |
|---|---|---|
| 28 | G –> C | No |
| 173 | G –> C | Yes |
| 256 | C –> T | Yes |
| 274 | G –> C | Yes |
| 325 | C –> | No |
| 389 | C –> G | Yes |
| 610 | G –> A | Yes |
| 718 | T –> | No |
| 724 | C –> | No |
| 844 | C –> T | Yes |
| 857 | –> G | No |
| 885 | C –> | No |
| 897 | –> G | No |
| 1002 | G –> A | No |
| 1048 | A –> | No |
| 1048 | A –> G | No |
| 1068 | A –> C | No |
| 1076 | G –> A | Yes |
| 1187 | A –> | No |
| 1187 | A –> C | No |
| 1220 | A –> G | No |
| 1220 | A –> T | No |
| 1254 | T –> G | No |
| 1291 | A –> C | No |
| 1293 | C –> G | No |
| 1303 | G –> A | No |
| 1376 | G –> T | Yes |

Variant protein T46984_PEA_1_P34 (SEQ ID NO: 393) according to the present invention has an amino acid sequence as given at the end of the application; it is encoded by transcript(s) T46984_PEA_1_T42 (SEQ ID NO: 327). An alignment is given to the known protein (Dolichyl-diphosphooligosaccharide—protein glycosyltransferase 63 kDa subunit precursor) at the end of the application. One or more alignments to one or more previously published protein sequences are given at the end of the application. A brief description of the relationship of the variant protein according to the present invention to each such aligned protein is as follows:

Comparison report between T46984_PEA_1_P34 (SEQ ID NO: 393) and RIB2_HUMAN:

1. An isolated chimeric polypeptide encoding for T46984_PEA_1_P34 (SEQ ID NO: 393), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFTPVG corresponding to amino acids 1-329 of RIB2_HUMAN, which also corresponds to amino acids 1-329 of T46984_PEA_1_P34 (SEQ ID NO: 393).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA_1_P34 (SEQ ID NO: 393) also has the following non-silent SNPs (Single Nucleotide Polymorphisms) as listed in Table 30, (given according to their position(s) on the amino acid sequence, with the alternative amino acid(s) listed; the last column indicates whether the SNP is known or not; the presence of known SNPs in variant protein T46984_PEA_1_P34 (SEQ ID NO: 393) sequence provides support for the deduced sequence of this variant protein according to the present invention).

TABLE 30

Amino acid mutations

| SNP position(s) on amino acid sequence | Alternative amino acid(s) | Previously known SNP? |
|---|---|---|
| 4 | P –> | No |
| 25 | P –> R | Yes |
| 99 | G –> R | Yes |
| 135 | F –> | No |
| 137 | L –> | No |
| 190 | R –> | No |
| 245 | N –> | No |
| 245 | N –> D | No |
| 251 | E –> D | No |
| 254 | S –> N | Yes |
| 291 | Q –> | No |
| 291 | Q –> P | No |
| 302 | Q –> L | No |
| 302 | Q –> R | No |
| 326 | T –> P | No |

The glycosylation sites of variant protein T46984_PEA_1_P34 (SEQ ID NO: 393), as compared to the known protein Dolichyl-diphosphooligosaccharide—protein glycosyltransferase 63 kDa subunit precursor, are described in Table 31 (given according to their position(s) on the amino acid sequence in the first column; the second column indicates whether the glycosylation site is present in the variant protein; and the last column indicates whether the position is different on the variant protein).

TABLE 31

Glycosylation site(s)

| Position(s) on known amino acid sequence | Present in variant protein? | Position in variant protein? |
|---|---|---|
| 106 | yes | 106 |

Variant protein T46984_PEA_1_P34 (SEQ ID NO: 393) is encoded by the following transcript(s): T46984_PEA_1_T42 (SEQ ID NO: 327), for which the sequence(s) is/are given at the end of the application. The coding portion of transcript T46984_PEA_1_T42 (SEQ ID NO: 327) is shown in bold; this coding portion starts at position 316 and ends at position 1302. The transcript also has the following SNPs as listed in Table 32 (given according to their position on the nucleotide sequence, with the alternative nucleic acid listed; the last column indicates whether the SNP is known or not; the presence of known SNPs in variant protein T46984_PEA_1_P34 (SEQ ID NO: 393) sequence provides support for the deduced sequence of this variant protein according to the present invention).

TABLE 32

Nucleic acid SNPs

| SNP position on nucleotide sequence | Alternative nucleic acid | Previously known SNP? |
|---|---|---|
| 28 | G -> C | No |
| 173 | G -> C | Yes |
| 256 | C -> T | Yes |
| 274 | G -> C | Yes |
| 325 | C -> | No |
| 389 | C -> G | Yes |
| 610 | G -> A | Yes |
| 718 | T -> | No |
| 724 | C -> | No |
| 844 | C -> T | Yes |
| 857 | -> G | No |
| 885 | C -> | No |
| 897 | -> G | No |
| 1002 | G -> A | No |
| 1048 | A -> | No |
| 1048 | A -> G | No |
| 1068 | A -> C | No |
| 1076 | G -> A | Yes |
| 1187 | A -> | No |
| 1187 | A -> C | No |
| 1220 | A -> G | No |
| 1220 | A -> T | No |
| 1254 | T -> G | No |
| 1291 | A -> C | No |
| 1293 | C -> G | No |
| 1324 | T -> C | Yes |
| 1489 | G -> A | Yes |

Variant protein T46984_PEA_1_P35 (SEQ ID NO: 394) according to the present invention has an amino acid sequence as given at the end of the application; it is encoded by transcript(s) T46984_PEA_1_T43 (SEQ ID NO: 328). An alignment is given to the known protein (Dolichyl-diphosphooligosaccharide—protein glycosyltransferase 63 kDa subunit precursor) at the end of the application. One or more alignments to one or more previously published protein sequences are given at the end of the application. A brief description of the relationship of the variant protein according to the present invention to each such aligned protein is as follows:

Comparison report between T46984_PEA_1_P35 (SEQ ID NO: 394) and RIB2_HUMAN:

1. An isolated chimeric polypeptide encoding for T46984_PEA_1_P35 (SEQ ID NO: 394), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAI corresponding to amino acids 1-287 of RIB2_HUMAN, which also corresponds to amino acids 1-287 of T46984_PEA_1_P35 (SEQ ID NO: 394), and a second amino acid sequence being at least 70%, optionally at least 80%, preferably at least 85%, more preferably at least 90% and most preferably at least 95% homologous to a polypeptide having the sequence GCWPSRQS-REQHISSRRKMEILKTECQEKESRTIHSMRRKMEKKNFI (SEQ ID NO: 1066) corresponding to amino acids 288-334 of T46984_PEA_1_P35 (SEQ ID NO: 394), wherein said first amino acid sequence and second amino acid sequence are contiguous and in a sequential order.

2. An isolated polypeptide encoding for a tail of T46984_PEA_1_P35 (SEQ ID NO: 394), comprising a polypeptide being at least 70%, optionally at least about 80%, preferably at least about 85%, more preferably at least about 90% and most preferably at least about 95% homologous to the sequence GCWPSRQSREQHISSRRKMEILKTEC-QEKESRTIHSMRRKMEKKNFI (SEQ ID NO: 1066) in T46984_PEA_1_P35 (SEQ ID NO: 394).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA_1_P35 (SEQ ID NO: 394) also has the following non-silent SNPs (Single Nucleotide Polymorphisms) as listed in Table 33, (given according to their position(s) on the amino acid sequence, with the alternative amino acid(s) listed; the last column indicates whether the SNP is known or not; the presence of known SNPs in variant protein T46984_PEA_1_P35 (SEQ ID NO: 394) sequence provides support for the deduced sequence of this variant protein according to the present invention).

TABLE 33

Amino acid mutations

| SNP position(s) on amino acid sequence | Alternative amino acid(s) | Previously known SNP? |
|---|---|---|
| 4 | P -> | No |
| 25 | P -> R | Yes |
| 99 | G -> R | Yes |
| 135 | F -> | No |
| 137 | L -> | No |
| 190 | R -> | No |
| 245 | N -> | No |
| 245 | N -> D | No |
| 251 | E -> D | No |
| 254 | S -> N | Yes |
| 320 | T -> P | No |
| 324 | M -> L | No |
| 329 | E -> K | Yes |
| 334 | I -> V | No |

The glycosylation sites of variant protein T46984_PEA_1_P35 (SEQ ID NO: 394), as compared to the known protein Dolichyl-diphosphooligosaccharide—protein glycosyltransferase 63 kDa subunit precursor, are described in Table 34 (given according to their position(s) on the amino acid sequence in the first column; the second column indicates whether the glycosylation site is present in the variant protein; and the last column indicates whether the position is different on the variant protein).

TABLE 34

Glycosylation site(s)

| Position(s) on known amino acid sequence | Present in variant protein? | Position in variant protein? |
|---|---|---|
| 106 | yes | 106 |

Variant protein T46984_PEA_1_P35 (SEQ ID NO: 394) is encoded by the following transcript(s): T46984_PEA_1_T43 (SEQ ID NO: 328), for which the sequence(s) is/are given at the end of the application. The coding portion of transcript T46984_PEA_1_T43 (SEQ ID NO: 328) is shown in bold; this coding portion starts at position 316 and ends at position 1317. The transcript also has the following SNPs as listed in Table 35 (given according to their position on the nucleotide sequence, with the alternative nucleic acid listed; the last column indicates whether the SNP is known or not; the presence of known SNPs in variant protein T46984_PEA_1_P35 (SEQ ID NO: 394) sequence provides support for the deduced sequence of this variant protein according to the present invention).

TABLE 35

Nucleic acid SNPs

| SNP position on nucleotide sequence | Alternative nucleic acid | Previously known SNP? |
|---|---|---|
| 28 | G –> C | No |
| 173 | G –> C | Yes |
| 256 | C –> T | Yes |
| 274 | G –> C | Yes |
| 325 | C –> | No |
| 389 | C –> G | Yes |
| 610 | G –> A | Yes |
| 718 | T –> | No |
| 724 | C –> | No |
| 844 | C –> T | Yes |
| 857 | –> G | No |
| 885 | C –> | No |
| 897 | –> G | No |
| 1002 | G –> A | No |
| 1048 | A –> | No |
| 1048 | A –> G | No |
| 1068 | A –> C | No |
| 1076 | G –> A | Yes |
| 1240 | C –> T | No |
| 1273 | A –> C | No |
| 1285 | A –> T | No |
| 1300 | G –> A | Yes |
| 1306 | –> A | No |
| 1315 | A –> G | No |
| 1340 | T –> G | No |
| 1354 | T –> A | No |
| 1354 | T –> G | No |
| 1454 | –> C | No |
| 1463 | T –> | No |
| 1522 | A –> C | No |

Variant protein T46984_PEA_1_P38 (SEQ ID NO: 395) according to the present invention has an amino acid sequence as given at the end of the application; it is encoded by transcript(s) T46984_PEA_1_T47 (SEQ ID NO: 330). An alignment is given to the known protein (Dolichyl-diphosphooligosaccharide—protein glycosyltransferase 63 kDa subunit precursor) at the end of the application. One or more alignments to one or more previously published protein sequences are given at the end of the application. A brief description of the relationship of the variant protein according to the present invention to each such aligned protein is as follows:

Comparison report between T46984_PEA_1_P38 (SEQ ID NO: 395) and RIB2_HUMAN:

1. An isolated chimeric polypeptide encoding for T46984_PEA_1_P38 (SEQ ID NO: 395), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEAL corresponding to amino acids 1-145 of RIB2_HUMAN, which also corresponds to amino acids 1-145 of T46984_PEA_1_P38 (SEQ ID NO: 395), and a second amino acid sequence being at least 70%, optionally at least 80%, preferably at least 85%, more preferably at least 90% and most preferably at least 95% homologous to a polypeptide having the sequence MDPDWCQCLQLHFCS (SEQ ID NO: 1067) corresponding to amino acids 146-160 of T46984_PEA_1_P38 (SEQ ID NO: 395), wherein said first amino acid sequence and second amino acid sequence are contiguous and in a sequential order.

2. An isolated polypeptide encoding for a tail of T46984_PEA_1_P38 (SEQ ID NO: 395), comprising a polypeptide being at least 70%, optionally at least about 80%, preferably at least about 85%, more preferably at least about 90% and most preferably at least about 95% homologous to the sequence MDPDWCQCLQLHFCS (SEQ ID NO: 1067) in T46984_PEA_1_P38 (SEQ ID NO: 395).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA_1_P38 (SEQ ID NO: 395) also has the following non-silent SNPs (Single Nucleotide Polymorphisms) as listed in Table 36, (given according to their position(s) on the amino acid sequence, with the alternative amino acid(s) listed; the last column indicates whether the SNP is known or not; the presence of known SNPs in variant protein T46984_PEA_1_P38 (SEQ ID NO: 395) sequence provides support for the deduced sequence of this variant protein according to the present invention).

TABLE 36

Amino acid mutations

| SNP position(s) on amino acid sequence | Alternative amino acid(s) | Previously known SNP? |
|---|---|---|
| 4 | P –> | No |
| 25 | P –> R | Yes |
| 99 | G –> R | Yes |
| 135 | F –> | No |
| 137 | L –> | No |

The glycosylation sites of variant protein T46984_PEA_1_P38 (SEQ ID NO: 395), as compared to the known protein Dolichyl-diphosphooligosaccharide—protein glycosyltransferase 63 kDa subunit precursor, are described in Table 37 (given according to their position(s) on the amino acid sequence in the first column; the second column indicates whether the glycosylation site is present in the variant protein; and the last column indicates whether the position is different on the variant protein).

TABLE 37

| Glycosylation site(s) | | |
| --- | --- | --- |
| Position(s) on known amino acid sequence | Present in variant protein? | Position in variant protein? |
| 106 | yes | 106 |

Variant protein T46984_PEA_1_P38 (SEQ ID NO: 395) is encoded by the following transcript(s): T46984_PEA_1_T47 (SEQ ID NO: 330), for which the sequence(s) is/are given at the end of the application. The coding portion of transcript T46984_PEA_1_T47 (SEQ ID NO: 330) is shown in bold; this coding portion starts at position 316 and ends at position 795. The transcript also has the following SNPs as listed in Table 38 (given according to their position on the nucleotide sequence, with the alternative nucleic acid listed; the last column indicates whether the SNP is known or not; the presence of known SNPs in variant protein T46984_PEA_1_P38 (SEQ ID NO: 395) sequence provides support for the deduced sequence of this variant protein according to the present invention).

TABLE 38

| Nucleic acid SNPs | | |
| --- | --- | --- |
| SNP position on nucleotide sequence | Alternative nucleic acid | Previously known SNP? |
| 28 | G -> C | No |
| 173 | G -> C | Yes |
| 256 | C -> T | Yes |
| 274 | G -> C | Yes |
| 325 | C -> | No |
| 389 | C -> G | Yes |
| 610 | G -> A | Yes |
| 718 | T -> | No |
| 724 | C -> | No |
| 879 | C -> A | No |
| 899 | T -> C | Yes |
| 993 | C -> T | No |
| 1026 | A -> C | No |
| 1038 | A -> T | No |
| 1053 | G -> A | Yes |
| 1059 | -> A | No |
| 1068 | A -> G | No |
| 1093 | T -> G | No |
| 1107 | T -> A | No |
| 1107 | T -> G | No |
| 1207 | -> C | No |
| 1216 | T -> | No |
| 1275 | A -> C | No |

Variant protein T46984_PEA_1_P39 (SEQ ID NO: 396) according to the present invention has an amino acid sequence as given at the end of the application; it is encoded by transcript(s) T46984_PEA_1_T48 (SEQ ID NO: 331). An alignment is given to the known protein (Dolichyl-diphosphooligosaccharide—protein glycosyltransferase 63 kDa subunit precursor) at the end of the application. One or more alignments to one or more previously published protein sequences are given at the end of the application. A brief description of the relationship of the variant protein according to the present invention to each such aligned protein is as follows:

Comparison report between T46984_PEA_1_P39 (SEQ ID NO: 396) and RIB2_HUMAN:

1. An isolated chimeric polypeptide encoding for T46984_PEA_1_P39 (SEQ ID NO: 396), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLA corresponding to amino acids 1-160 of RIB2_HUMAN, which also corresponds to amino acids 1-160 of T46984_PEA_1_P39 (SEQ ID NO: 396).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA_1_P39 (SEQ ID NO: 396) also has the following non-silent SNPs (Single Nucleotide Polymorphisms) as listed in Table 39, (given according to their position(s) on the amino acid sequence, with the alternative amino acid(s) listed; the last column indicates whether the SNP is known or not; the presence of known SNPs in variant protein T46984_PEA_1_P39 (SEQ ID NO: 396) sequence provides support for the deduced sequence of this variant protein according to the present invention).

TABLE 39

| Amino acid mutations | | |
| --- | --- | --- |
| SNP position(s) on amino acid sequence | Alternative amino acid(s) | Previously known SNP? |
| 4 | P -> | No |
| 25 | P -> R | Yes |
| 99 | G -> R | Yes |
| 135 | F -> | No |
| 137 | L -> | No |

The glycosylation sites of variant protein T46984_PEA_1_P39 (SEQ ID NO: 396), as compared to the known protein Dolichyl-diphosphooligosaccharide—protein glycosyltransferase 63 kDa subunit precursor, are described in Table 40 (given according to their position(s) on the amino acid sequence in the first column; the second column indicates whether the glycosylation site is present in the variant protein; and the last column indicates whether the position is different on the variant protein).

TABLE 40

| Glycosylation site(s) | | |
| --- | --- | --- |
| Position(s) on known amino acid sequence | Present in variant protein? | Position in variant protein? |
| 106 | yes | 106 |

Variant protein T46984_PEA_1_P39 (SEQ ID NO: 396) is encoded by the following transcript(s): T46984_PEA_1_T48 (SEQ ID NO: 331), for which the sequence(s) is/are given at the end of the application. The coding portion of transcript T46984_PEA_1_T48 (SEQ ID NO: 331) is shown in bold; this coding portion starts at position 316 and ends at position 795. The transcript also has the following SNPs as listed in Table 41 (given according to their position on the nucleotide sequence, with the alternative nucleic acid listed; the last column indicates whether the SNP is known or not; the presence of known SNPs in variant protein T46984_PEA_1_P39 (SEQ ID NO: 396) sequence provides support for the deduced sequence of this variant protein according to the present invention).

TABLE 41

Nucleic acid SNPs

| SNP position on nucleotide sequence | Alternative nucleic acid | Previously known SNP? |
|---|---|---|
| 28 | G -> C | No |
| 173 | G -> C | Yes |
| 256 | C -> T | Yes |
| 274 | G -> C | Yes |
| 325 | C -> | No |
| 389 | C -> G | Yes |
| 610 | G -> A | Yes |
| 718 | T -> | No |
| 724 | C -> | No |
| 848 | G -> T | Yes |
| 879 | C -> G | Yes |
| 1008 | A -> G | Yes |
| 1397 | A -> G | Yes |

Variant protein T46984_PEA_1_P45 (SEQ ID NO: 397) according to the present invention has an amino acid sequence as given at the end of the application; it is encoded by transcript(s) T46984_PEA_1_T32 (SEQ ID NO: 323). An alignment is given to the known protein (Dolichyl-diphosphooligosaccharide—protein glycosyltransferase 63 kDa subunit precursor) at the end of the application. One or more alignments to one or more previously published protein sequences are given at the end of the application. A brief description of the relationship of the variant protein according to the present invention to each such aligned protein is as follows:

Comparison report between T46984_PEA_1_P45 (SEQ ID NO: 397) and RIB2_HUMAN:

1. An isolated chimeric polypeptide encoding for T46984_PEA_1_P45 (SEQ ID NO: 397), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCE corresponding to amino acids 1-101 of RIB2_HUMAN, which also corresponds to amino acids 1-101 of T46984_PEA_1_P45 (SEQ ID NO: 397), and a second amino acid sequence being at least 70%, optionally at least 80%, preferably at least 85%, more preferably at least 90% and most preferably at least 95% homologous to a polypeptide having the sequence NSPGSADSIPPVPAG (SEQ ID NO: 1068) corresponding to amino acids 102-116 of T46984_PEA_1_P45 (SEQ ID NO: 397), wherein said first amino acid sequence and second amino acid sequence are contiguous and in a sequential order.

2. An isolated polypeptide encoding for a tail of T46984_PEA_1_P45 (SEQ ID NO: 397), comprising a polypeptide being at least 70%, optionally at least about 80%, preferably at least about 85%, more preferably at least about 90% and most preferably at least about 95% homologous to the sequence NSPGSADSIPPVPAG (SEQ ID NO: 1068) in T46984_PEA_1_P45 (SEQ ID NO: 397).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA_1_P45 (SEQ ID NO: 397) also has the following non-silent SNPs (Single Nucleotide Polymorphisms) as listed in Table 42, (given according to their position(s) on the amino acid sequence, with the alternative amino acid(s) listed; the last column indicates whether the SNP is known or not; the presence of known SNPs in variant protein T46984_PEA_1_P45 (SEQ ID NO: 397) sequence provides support for the deduced sequence of this variant protein according to the present invention).

TABLE 42

Amino acid mutations

| SNP position(s) on amino acid sequence | Alternative amino acid(s) | Previously known SNP? |
|---|---|---|
| 4 | P -> | No |
| 25 | P -> R | Yes |
| 99 | G -> R | Yes |

The glycosylation sites of variant protein T46984_PEA_1_P45 (SEQ ID NO: 397), as compared to the known protein Dolichyl-diphosphooligosaccharide—protein glycosyltransferase 63 kDa subunit precursor, are described in Table 43 (given according to their position(s) on the amino acid sequence in the first column; the second column indicates whether the glycosylation site is present in the variant protein; and the last column indicates whether the position is different on the variant protein).

TABLE 43

Glycosylation site(s)

| Position(s) on known amino acid sequence | Present in variant protein? |
|---|---|
| 106 | no |

Variant protein T46984_PEA_1_P45 (SEQ ID NO: 397) is encoded by the following transcript(s): T46984_PEA_1_T32 (SEQ ID NO: 323), for which the sequence(s) is/are given at the end of the application. The coding portion of transcript T46984_PEA_1_T32 (SEQ ID NO: 323) is shown in bold; this coding portion starts at position 316 and ends at position 663. The transcript also has the following SNPs as listed in Table 44 (given according to their position on the nucleotide sequence, with the alternative nucleic acid listed; the last column indicates whether the SNP is known or not; the presence of known SNPs in variant protein T46984_PEA_1_P45 (SEQ ID NO: 397) sequence provides support for the deduced sequence of this variant protein according to the present invention).

TABLE 44

Nucleic acid SNPs

| SNP position on nucleotide sequence | Alternative nucleic acid | Previously known SNP? |
|---|---|---|
| 28 | G -> C | No |
| 173 | G -> C | Yes |
| 256 | C -> T | Yes |
| 274 | G -> C | Yes |
| 325 | C -> | No |
| 389 | C -> G | Yes |
| 610 | G -> A | Yes |
| 668 | C -> T | Yes |
| 681 | -> G | No |
| 709 | C -> | No |
| 721 | -> G | No |
| 826 | G -> A | No |
| 872 | A -> | No |
| 872 | A -> G | No |
| 892 | A -> C | No |
| 900 | G -> A | Yes |
| 1011 | A -> | No |
| 1011 | A -> C | No |
| 1044 | A -> G | No |
| 1044 | A -> T | No |
| 1078 | T -> G | No |
| 1115 | A -> C | No |
| 1117 | C -> G | No |
| 1127 | G -> A | No |
| 1200 | G -> T | Yes |
| 1412 | A -> C | No |
| 1442 | T -> | No |
| 1442 | T -> C | No |
| 1484 | T -> | No |
| 1517 | A -> C | No |
| 1517 | A -> T | No |
| 1748 | C -> | No |
| 1748 | C -> A | No |
| 1755 | C -> | No |
| 1759 | G -> | No |
| 1944 | C -> A | No |
| 1964 | T -> C | Yes |
| 2058 | C -> T | No |
| 2091 | A -> C | No |
| 2103 | A -> T | No |
| 2118 | G -> A | Yes |
| 2124 | -> A | No |
| 2133 | A -> G | No |
| 2158 | T -> G | No |
| 2172 | T -> A | No |
| 2172 | T -> G | No |
| 2272 | -> C | No |
| 2281 | T -> | No |
| 2340 | A -> C | No |

Variant protein T46984_PEA_1_P46 (SEQ ID NO: 398) according to the present invention has an amino acid sequence as given at the end of the application; it is encoded by transcript(s) T46984_PEA_1_T35 (SEQ ID NO: 325). An alignment is given to the known protein (Dolichyl-diphosphooligosaccharide—protein glycosyltransferase 63 kDa subunit precursor) at the end of the application. One or more alignments to one or more previously published protein sequences are given at the end of the application. A brief description of the relationship of the variant protein according to the present invention to each such aligned protein is as follows:

Comparison report between T46984_PEA_1_P46 (SEQ ID NO: 398) and RIB2_HUMAN:

1. An isolated chimeric polypeptide encoding for T46984_PEA_1_P46 (SEQ ID NO: 398), comprising a first amino acid sequence being at least 90% homologous to MAPPGSSTVFLLALTIIASTWALTPTH-YLTKHDVERLKASLDRPFTNLESAFYSIVGLSSL GAQVPDAK corresponding to amino acids 1-69 of RIB2_HUMAN, which also corresponds to amino acids 1-69 of T46984_PEA_1_P46 (SEQ ID NO: 398), and a second amino acid sequence being at least 70%, optionally at least 80%, preferably at least 85%, more preferably at least 90% and most preferably at least 95% homologous to a polypeptide having the sequence NSPGSADSIPPVPAG (SEQ ID NO: 1068) corresponding to amino acids 70-84 of T46984_PEA_1_P46 (SEQ ID NO: 398), wherein said first amino acid sequence and second amino acid sequence are contiguous and in a sequential order.

2. An isolated polypeptide encoding for a tail of T46984_PEA_1_P46 (SEQ ID NO: 398), comprising a polypeptide being at least 70%, optionally at least about 80%, preferably at least about 85%, more preferably at least about 90% and most preferably at least about 95% homologous to the sequence NSPGSADSIPPVPAG (SEQ ID NO: 1068) in T46984_PEA_1_P46 (SEQ ID NO: 398).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA_1_P46 (SEQ ID NO: 398) also has the following non-silent SNPs (Single Nucleotide Polymorphisms) as listed in Table 45, (given according to their position(s) on the amino acid sequence, with the alternative amino acid(s) listed; the last column indicates whether the SNP is known or not; the presence of known SNPs in variant protein T46984_PEA_1_P46 (SEQ ID NO: 398) sequence provides support for the deduced sequence of this variant protein according to the present invention).

TABLE 45

Amino acid mutations

| SNP position(s) on amino acid sequence | Alternative amino acid(s) | Previously known SNP? |
|---|---|---|
| 4 | P -> | No |
| 25 | P -> R | Yes |

The glycosylation sites of variant protein T46984_PEA_1_P46 (SEQ ID NO: 398), as compared to the known protein Dolichyl-diphosphooligosaccharide—protein glycosyltransferase 63 kDa subunit precursor, are described in Table 46 (given according to their position(s) on the amino acid sequence in the first column; the second column indicates whether the glycosylation site is present in the variant protein; and the last column indicates whether the position is different on the variant protein).

TABLE 46

Glycosylation site(s)

| Position(s) on known amino acid sequence | Present in variant protein? |
|---|---|
| 106 | no |

Variant protein T46984_PEA_1_P46 (SEQ ID NO: 398) is encoded by the following transcript(s): T46984_PEA_

1_T35 (SEQ ID NO: 325), for which the sequence(s) is/are given at the end of the application. The coding portion of transcript T46984_PEA_1_T35 (SEQ ID NO: 325) is shown in bold; this coding portion starts at position 316 and ends at position 567. The transcript also has the following SNPs as listed in Table 47 (given according to their position on the nucleotide sequence, with the alternative nucleic acid listed; the last column indicates whether the SNP is known or not; the presence of known SNPs in variant protein T46984_PEA_1_P46 (SEQ ID NO: 398) sequence provides support for the deduced sequence of this variant protein according to the present invention).

TABLE 47

Nucleic acid SNPs

| SNP position on nucleotide sequence | Alternative nucleic acid | Previously known SNP? |
|---|---|---|
| 28 | G -> C | No |
| 173 | G -> C | Yes |
| 256 | C -> T | Yes |
| 274 | G -> C | Yes |
| 325 | C -> | No |
| 389 | C -> G | Yes |
| 572 | C -> T | Yes |
| 585 | -> G | No |
| 613 | C -> | No |
| 625 | -> G | No |
| 730 | G -> A | No |
| 776 | A -> | No |
| 776 | A -> G | No |
| 796 | A -> C | No |
| 804 | G -> A | Yes |
| 915 | A -> | No |
| 915 | A -> C | No |
| 948 | A -> G | No |
| 948 | A -> T | No |
| 982 | T -> G | No |
| 1019 | A -> C | No |
| 1021 | C -> G | No |
| 1031 | G -> A | No |
| 1104 | G -> T | Yes |
| 1316 | A -> C | No |
| 1346 | T -> | No |
| 1346 | T -> C | No |
| 1388 | T -> | No |
| 1421 | A -> C | No |
| 1421 | A -> T | No |
| 1652 | C -> | No |
| 1652 | C -> A | No |
| 1659 | C -> | No |
| 1663 | G -> | No |
| 1848 | C -> A | No |
| 1868 | T -> C | Yes |
| 1962 | C -> T | No |
| 1995 | A -> C | No |
| 2007 | A -> T | No |
| 2022 | G -> A | Yes |
| 2028 | -> A | No |
| 2037 | A -> G | No |
| 2062 | T -> G | No |
| 2076 | T -> A | No |
| 2076 | T -> G | No |
| 2176 | -> C | No |
| 2185 | T -> | No |
| 2244 | A -> C | No |

As noted above, cluster T46984 features 49 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T46984_PEA_1_node_2 (SEQ ID NO: 335) according to the present invention is supported by 240 libraries. The number of libraries was determined as previously described. This segment can be found in the following transcript(s): T46984_PEA_1_T2 (SEQ ID NO: 314) (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T40 (SEQ ID NO: 326), T46984_PEA_1_T42 (SEQ ID NO: 327), T46984_PEA_1_T43 (SEQ ID NO: 328), T46984_PEA_1_T47 (SEQ ID NO: 330) and T46984_PEA_1_T48 (SEQ ID NO: 331). Table 48 below describes the starting and ending position of this segment on each transcript.

TABLE 48

Segment location on transcripts

| Transcript name | Segment starting position | Segment ending position |
|---|---|---|
| T46984_PEA_1_T2 (SEQ ID NO: 314) | 1 | 328 |
| T46984_PEA_1_T3 (SEQ ID NO: 315) | 1 | 328 |
| T46984_PEA_1_T12 (SEQ ID NO: 316) | 1 | 328 |
| T46984_PEA_1_T13 (SEQ ID NO: 317) | 1 | 328 |
| T46984_PEA_1_T14 (SEQ ID NO: 318) | 1 | 328 |
| T46984_PEA_1_T15 (SEQ ID NO: 319) | 1 | 328 |
| T46984_PEA_1_T19 (SEQ ID NO: 320) | 1 | 328 |
| T46984_PEA_1_T23 (SEQ ID NO: 321) | 1 | 328 |
| T46984_PEA_1_T32 (SEQ ID NO: 323) | 1 | 328 |
| T46984_PEA_1_T34 (SEQ ID NO: 324) | 1 | 328 |
| 146984_PEA_1_T35 (SEQ ID NO: 325) | 1 | 328 |
| T46984_PEA_1_T40 (SEQ ID NO: 326) | 1 | 328 |
| T46984_PEA_1_T42 (SEQ ID NO: 327) | 1 | 328 |
| T46984_PEA_1_T43 (SEQ ID NO: 328) | 1 | 328 |
| T46984_PEA_1_T47 (SEQ ID NO: 330) | 1 | 328 |
| T46984_PEA_1_T48 (SEQ ID NO: 331) | 1 | 328 |

Segment cluster T46984_PEA_1_node_4 (SEQ ID NO: 336) according to the present invention is supported by 321 libraries. The number of libraries was determined as previously described. This segment can be found in the following transcript(s): T46984_PEA_1_T2 (SEQ ID NO: 314) (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T32 (SEQ ID NO: 323), T46984_PEA_1_T34 (SEQ ID NO: 324), T46984_PEA_1_T35 (SEQ ID NO: 325), T46984_PEA_

1_T40 (SEQ ID NO: 326), T46984_PEA_1_T42 (SEQ ID NO: 327), T46984_PEA_1_T43 (SEQ ID NO: 328), T46984_PEA_1_T47 (SEQ ID NO: 330) and T46984_PEA_1_T48 (SEQ ID NO: 331). Table 49 below describes the starting and ending position of this segment on each transcript.

TABLE 49

Segment location on transcripts

| Transcript name | Segment starting position | Segment ending position |
|---|---|---|
| T46984_PEA_1_T2 (SEQ ID NO: 314) | 329 | 522 |
| T46984_PEA_1_T3 (SEQ ID NO: 315) | 329 | 522 |
| T46984_PEA_1_T12 (SEQ ID NO: 316) | 329 | 522 |
| T46984_PEA_1_T13 (SEQ ID NO: 317) | 329 | 522 |
| T46984_PEA_1_T14 (SEQ ID NO: 318) | 329 | 522 |
| T46984_PEA_1_T15 (SEQ ID NO: 319) | 329 | 522 |
| T46984_PEA_1_T19 (SEQ ID NO: 320) | 329 | 522 |
| T46984_PEA_1_T23 (SEQ ID NO: 321) | 329 | 522 |
| T46984_PEA_1_T32 (SEQ ID NO: 323) | 329 | 522 |
| T46984_PEA_1_T34 (SEQ ID NO: 324) | 329 | 522 |
| 146984_PEA_1_T35 (SEQ ID NO: 325) | 329 | 522 |
| T46984_PEA_1_T40 (SEQ ID NO: 326) | 329 | 522 |
| T46984_PEA_1_T42 (SEQ ID NO: 327) | 329 | 522 |
| T46984_PEA_1_T43 (SEQ ID NO: 328) | 329 | 522 |
| T46984_PEA_1_T47 (SEQ ID NO: 330) | 329 | 522 |
| T46984_PEA_1_T48 (SEQ ID NO: 331) | 329 | 522 |

Segment cluster T46984_PEA_1_node_6 (SEQ ID NO: 337) according to the present invention is supported by 3 libraries. The number of libraries was determined as previously described. This segment can be found in the following transcript(s): T46984_PEA_1_T27 (SEQ ID NO: 322). Table 50 below describes the starting and ending position of this segment on each transcript.

TABLE 50

Segment location on transcripts

| Transcript name | Segment starting position | Segment ending position |
|---|---|---|
| T46984_PEA_1_T27 (SEQ ID NO: 322) | 1 | 340 |

Segment cluster T46984_PEA_1_node_12 (SEQ ID NO: 338) according to the present invention is supported by 262 libraries. The number of libraries was determined as previously described. This segment can be found in the following transcript(s): T46984_PEA_1_T2 (SEQ ID NO: 314) (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T34 (SEQ ID NO: 324), T46984_PEA_1_T40 (SEQ ID NO: 326), T46984_PEA_1_T42 (SEQ ID NO: 327), T46984_PEA_1_T43 (SEQ ID NO: 328), T46984_PEA_1_T47 (SEQ ID NO: 330) and T46984_PEA_1_T48 (SEQ ID NO: 331). Table 51 below describes the starting and ending position of this segment on each transcript.

TABLE 51

Segment location on transcripts

| Transcript name | Segment starting position | Segment ending position |
|---|---|---|
| T46984_PEA_1_T2 (SEQ ID NO:314) | 619 | 751 |
| T46984_PEA_1_T3 (SEQ ID NO:315) | 619 | 751 |
| T46984_PEA_1_T12 (SEQ ID NO:316) | 619 | 751 |
| T46984_PEA_1_T13 (SEQ ID NO:317) | 619 | 751 |
| T46984_PEA_1_T14 (SEQ ID NO:318) | 619 | 751 |
| T46984_PEA_1_T15 (SEQ ID NO:319) | 619 | 751 |
| T46984_PEA_1_T19 (SEQ ID NO:320) | 619 | 751 |
| T46984_PEA_1_T23 (SEQ ID NO:321) | 619 | 751 |
| T46984_PEA_1_T27 (SEQ ID NO:322) | 437 | 569 |
| T46984_PEA_1_T34 (SEQ ID NO:324) | 619 | 751 |
| T46984_PEA_1_T40 (SEQ ID NO:326) | 619 | 751 |
| T46984_PEA_1_T42 (SEQ ID NO:327) | 619 | 751 |
| T46984_PEA_1_T43 (SEQ ID NO:328) | 619 | 751 |
| T46984_PEA_1_T47 (SEQ ID NO:330) | 619 | 751 |
| T46984_PEA_1_T48 (SEQ ID NO:331) | 619 | 751 |

Segment cluster T46984_PEA_1_node_14 (SEQ ID NO: 339) according to the present invention is supported by 2 libraries. The number of libraries was determined as previously described. This segment can be found in the following transcript(s): T46984_PEA_1_T48 (SEQ ID NO: 331). Table 52 below describes the starting and ending position of this segment on each transcript.

TABLE 52

Segment location on transcripts

| Transcript name | Segment starting position | Segment ending position |
|---|---|---|
| T46984_PEA_1_T48 (SEQ ID NO:331) | 795 | 1718 |

Segment cluster T46984_PEA_1_node_25 (SEQ ID NO: 340) according to the present invention is supported by 257 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T40 (SEQ ID NO: 326), T46984_PEA_1_T42 (SEQ ID NO: 327) and T46984_PEA_1_T43 (SEQ ID NO: 328). Table 53 below describes the starting and ending position of this segment on each transcript.

TABLE 53

Segment location on transcripts

| Transcript name | Segment starting position | Segment ending position |
|---|---|---|
| T46984_PEA_1_T2 (SEQ ID NO:314) | 1006 | 1171 |
| T46984_PEA_1_T3 (SEQ ID NO:315) | 1006 | 1171 |
| T46984_PEA_1_T12 (SEQ ID NO:316) | 1006 | 1171 |
| T46984_PEA_1_T13 (SEQ ID NO:317) | 1006 | 1171 |
| T46984_PEA_1_T14 (SEQ ID NO:318) | 1006 | 1171 |
| T46984_PEA_1_T15 (SEQ ID NO:319) | 1006 | 1171 |
| T46984_PEA_1_T19 (SEQ ID NO:320) | 1006 | 1171 |
| T46984_PEA_1_T23 (SEQ ID NO:321) | 1006 | 1171 |
| T46984_PEA_1_T27 (SEQ ID NO:322) | 824 | 989 |
| T46984_PEA_1_T32 (SEQ ID NO:323) | 830 | 995 |
| T46984_PEA_1_T34 (SEQ ID NO:324) | 1006 | 1171 |
| T46984_PEA_1_T35 (SEQ ID NO:325) | 734 | 899 |
| T46984_PEA_1_T40 (SEQ ID NO:326) | 1006 | 1171 |
| T46984_PEA_1_T42 (SEQ ID NO:327) | 1006 | 1171 |
| T46984_PEA_1_T43 (SEQ ID NO:328) | 1006 | 1171 |

Segment cluster T46984_PEA_1_node_29 (SEQ ID NO: 341) according to the present invention is supported by 1 libraries. The number of libraries was determined as previously described. This segment can be found in the following transcript(s): T46984_PEA_1_T42 (SEQ ID NO: 327). Table 54 below describes the starting and ending position of this segment on each transcript.

TABLE 54

Segment location on transcripts

| Transcript name | Segment starting position | Segment ending position |
|---|---|---|
| T46984_PEA_1_T42 (SEQ ID NO:327) | 1302 | 1501 |

Segment cluster T46984_PEA_1_node_34 (SEQ ID NO: 342) according to the present invention is supported by 4 libraries. The number of libraries was determined as previously described. This segment can be found in the following transcript(s): T46984_PEA_1_T40 (SEQ ID NO: 326). Table 55 below describes the starting and ending position of this segment on each transcript.

TABLE 55

Segment location on transcripts

| Transcript name | Segment starting position | Segment ending position |
|---|---|---|
| T46984_PEA_1_T40 (SEQ ID NO:326) | 1408 | 1717 |

Segment cluster T46984_PEA_1_node_46 (SEQ ID NO: 343) according to the present invention is supported by 1 libraries. The number of libraries was determined as previously described. This segment can be found in the following transcript(s): T46984_PEA_1_T46 (SEQ ID NO: 329). Table 56 below describes the starting and ending position of this segment on each transcript.

TABLE 56

Segment location on transcripts

| Transcript name | Segment starting position | Segment ending position |
|---|---|---|
| T46984_PEA_1_T46 (SEQ ID NO:329) | 1 | 306 |

Segment cluster T46984_PEA_1_node_47 (SEQ ID NO: 344) according to the present invention is supported by 5 libraries. The number of libraries was determined as previously described. This segment can be found in the following transcript(s): T46984_PEA_1_T3 (SEQ ID NO: 315), T46984_PEA_1_T19 (SEQ ID NO: 320) and T46984_PEA_1_T46 (SEQ ID NO: 329). Table 57 below describes the starting and ending position of this segment on each transcript.

TABLE 57

Segment location on transcripts

| Transcript name | Segment starting position | Segment ending position |
|---|---|---|
| T46984_PEA_1_T3 (SEQ ID NO:315) | 1615 | 2242 |
| T46984_PEA_1_T19 (SEQ ID NO:320) | 1615 | 2242 |
| T46984_PEA_1_T46 (SEQ ID NO:329) | 307 | 934 |

Segment cluster T46984_PEA_1_node_52 (SEQ ID NO: 345) according to the present invention is supported by 29 libraries. The number of libraries was determined as previously described. This segment can be found in the following transcript(s): T46984_PEA_1_T2 (SEQ ID NO: 314), T46984_PEA_1_T19 (SEQ ID NO: 320) and T46984_PEA_1_T23 (SEQ ID NO: 321). Table 58 below describes the starting and ending position of this segment on each transcript.

TABLE 58

Segment location on transcripts

| Transcript name | Segment starting position | Segment ending position |
|---|---|---|
| T46984_PEA_1_T2 (SEQ ID NO:314) | 1838 | 2904 |

TABLE 58-continued

Segment location on transcripts

| Transcript name | Segment starting position | Segment ending position |
|---|---|---|
| T46984_PEA_1_T19 (SEQ ID NO:320) | 2466 | 3532 |
| T46984_PEA_1_T23 (SEQ ID NO:321) | 1838 | 2904 |

Segment cluster T46984_PEA_1_node_6 (SEQ ID NO: 337)5 according to the present invention is supported by 2 libraries. The number of libraries was determined as previously described. This segment can be found in the following transcript(s): T46984_PEA_1_T51 (SEQ ID NO: 332). Table 59 below describes the starting and ending position of this segment on each transcript.

TABLE 59

Segment location on transcripts

| Transcript name | Segment starting position | Segment ending position |
|---|---|---|
| T46984_PEA_1_T51 (SEQ ID NO:332) | 1 | 348 |

Segment cluster T46984_PEA_1_node_69 (SEQ ID NO: 347) according to the present invention is supported by 8 libraries. The number of libraries was determined as previously described. This segment can be found in the following transcript(s): T46984_PEA_1_T52 (SEQ ID NO: 333) and T46984_PEA_1_T54 (SEQ ID NO: 334). Table 60 below describes the starting and ending position of this segment on each transcript.

TABLE 60

Segment location on transcripts

| Transcript name | Segment starting position | Segment ending position |
|---|---|---|
| T46984_PEA_1_T52 (SEQ ID NO:333) | 1 | 927 |
| T46984_PEA_1_T54 (SEQ ID NO:334) | 1 | 927 |

Segment cluster T46984_PEA_1_node_75 (SEQ ID NO: 348) according to the present invention is supported by 5 libraries. The number of libraries was determined as previously described. This segment can be found in the following transcript(s): T46984_PEA_1_T14 (SEQ ID NO: 318). Table 61 below describes the starting and ending position of this segment on each transcript.

TABLE 61

Segment location on transcripts

| Transcript name | Segment starting position | Segment ending position |
|---|---|---|
| T46984_PEA_1_T14 (SEQ ID NO:318) | 2199 | 3529 |

Segment cluster T46984_PEA_1_node_86 (SEQ ID NO: 349) according to the present invention is supported by 314 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T43 (SEQ ID NO: 328), T46984_PEA_1_T46 (SEQ ID NO: 329), T46984_PEA_1_T47 (SEQ ID NO: 330), T46984_PEA_1_T51 (SEQ ID NO: 332), T46984_PEA_1_T52 (SEQ ID NO: 333) and T46984_PEA_1_T54 (SEQ ID NO: 334). Table 62 below describes the starting and ending position of this segment on each transcript.

TABLE 62

Segment location on transcripts

| Transcript name | Segment starting position | Segment ending position |
|---|---|---|
| T46984_PEA_1_T2 (SEQ ID NO:314) | 3492 | 3750 |
| T46984_PEA_1_T3 (SEQ ID NO:315) | 2886 | 3144 |
| T46984_PEA_1_T12 (SEQ ID NO:316) | 2286 | 2544 |
| T46984_PEA_1_T13 (SEQ ID NO:317) | 2317 | 2575 |
| T46984_PEA_1_T15 (SEQ ID NO:319) | 2175 | 2433 |
| T46984_PEA_1_T19 (SEQ ID NO:320) | 4120 | 4378 |
| T46984_PEA_1_T23 (SEQ ID NO:321) | 3396 | 3654 |
| T46984_PEA_1_T27 (SEQ ID NO:322) | 2076 | 2334 |
| T46984_PEA_1_T32 (SEQ ID NO:323) | 2082 | 2340 |
| T46984_PEA_1_T34 (SEQ ID NO:324) | 1828 | 2086 |
| T46984_PEA_1_T35 (SEQ ID NO:325) | 1986 | 2244 |
| T46984_PEA_1_T43 (SEQ ID NO:328) | 1264 | 1522 |
| T46984_PEA_1_T46 (SEQ ID NO:329) | 1578 | 1836 |
| T46984_PEA_1_T47 (SEQ ID NO:330) | 1017 | 1275 |
| T46984_PEA_1_T51 (SEQ ID NO:332) | 614 | 872 |
| T46984_PEA_1_T52 (SEQ ID NO:333) | 1117 | 1375 |
| T46984_PEA_1_T54 (SEQ ID NO:334) | 1117 | 1602 |

According to an optional embodiment of the present invention, short segments related to the above cluster are also provided. These segments are up to about 120 bp in length, and so are included in a separate description.

Segment cluster T46984_PEA_1_node_9 (SEQ ID NO: 350) according to the present invention is supported by 304 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T40 (SEQ ID NO: 326), T46984_PEA_1_T42 (SEQ ID NO: 327), T46984_PEA_1_T43 (SEQ ID NO: 328), T46984_PEA_1_T47 (SEQ ID NO: 330) and T46984_PEA_1_T48 (SEQ ID NO: 331). Table 63 below describes the starting and ending position of this segment on each transcript.

TABLE 63

Segment location on transcripts

| Transcript name | Segment starting position | Segment ending position |
|---|---|---|
| T46984_PEA_1_T2 (SEQ ID NO:314) | 523 | 618 |
| T46984_PEA_1_T3 (SEQ ID NO:315) | 523 | 618 |
| T46984_PEA_1_T12 (SEQ ID NO:316) | 523 | 618 |
| T46984_PEA_1_T13 (SEQ ID NO:317) | 523 | 618 |
| T46984_PEA_1_T14 (SEQ ID NO:318) | 523 | 618 |
| T46984_PEA_1_T15 (SEQ ID NO:319) | 523 | 618 |
| T46984_PEA_1_T19 (SEQ ID NO:320) | 523 | 618 |
| T46984_PEA_1_T23 (SEQ ID NO:321) | 523 | 618 |
| T46984_PEA_1_T27 (SEQ ID NO:322) | 341 | 436 |
| T46984_PEA_1_T32 (SEQ ID NO:323) | 523 | 618 |
| T46984_PEA_1_T34 (SEQ ID NO:324) | 523 | 618 |
| T46984_PEA_1_T40 (SEQ ID NO:326) | 523 | 618 |
| T46984_PEA_1_T42 (SEQ ID NO:327) | 523 | 618 |
| T46984_PEA_1_T43 (SEQ ID NO:328) | 523 | 618 |
| T46984_PEA_1_T47 (SEQ ID NO:330) | 523 | 618 |
| T46984_PEA_1_T48 (SEQ ID NO:331) | 523 | 618 |

Segment cluster T46984_PEA_1_node_13 (SEQ ID NO: 351) according to the present invention is supported by 232 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T34 (SEQ ID NO: 324), T46984_PEA_1_T40 (SEQ ID NO: 326), T46984_PEA_1_T42 (SEQ ID NO: 327), T46984_PEA_1_T43 (SEQ ID NO: 328) and T46984_PEA_1_T48 (SEQ ID NO: 331). Table 64 below describes the starting and ending position of this segment on each transcript.

TABLE 64

Segment location on transcripts

| Transcript name | Segment starting position | Segment ending position |
|---|---|---|
| T46984_PEA_1_T2 (SEQ ID NO:314) | 752 | 794 |
| T46984_PEA_1_T3 (SEQ ID NO:315) | 752 | 794 |
| T46984_PEA_1_T12 (SEQ ID NO:316) | 752 | 794 |
| T46984_PEA_1_T13 (SEQ ID NO:317) | 752 | 794 |
| T46984_PEA_1_T14 (SEQ ID NO:318) | 752 | 794 |
| T46984_PEA_1_T15 (SEQ ID NO:319) | 752 | 794 |
| T46984_PEA_1_T19 (SEQ ID NO:320) | 752 | 794 |
| T46984_PEA_1_T23 (SEQ ID NO:321) | 752 | 794 |
| T46984_PEA_1_T27 (SEQ ID NO:322) | 570 | 612 |
| T46984_PEA_1_T34 (SEQ ID NO:324) | 752 | 794 |
| T46984_PEA_1_T40 (SEQ ID NO:326) | 752 | 794 |
| T46984_PEA_1_T42 (SEQ ID NO:327) | 752 | 794 |
| T46984_PEA_1_T43 (SEQ ID NO:328) | 752 | 794 |
| T46984_PEA_1_T48 (SEQ ID NO:331) | 752 | 794 |

Segment cluster T46984_PEA_1_node_19 (SEQ ID NO: 352) according to the present invention is supported by 237 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T40 (SEQ ID NO: 326), T46984_PEA_1_T42 (SEQ ID NO: 327) and T46984_PEA_1_T43 (SEQ ID NO: 328). Table 65 below describes the starting and ending position of this segment on each transcript.

TABLE 65

Segment location on transcripts

| Transcript name | Segment starting position | Segment ending position |
|---|---|---|
| T46984_PEA_1_T2 (SEQ ID NO:314) | 795 | 870 |
| T46984_PEA_1_T3 (SEQ ID NO:315) | 795 | 870 |
| T46984_PEA_1_T12 (SEQ ID NO:316) | 795 | 870 |
| T46984_PEA_1_T13 (SEQ ID NO:317) | 795 | 870 |
| T46984_PEA_1_T14 (SEQ ID NO:318) | 795 | 870 |
| T46984_PEA_1_T15 (SEQ ID NO:319) | 795 | 870 |

TABLE 65-continued

Segment location on transcripts

| Transcript name | Segment starting position | Segment ending position |
|---|---|---|
| T46984_PEA_1_T19 (SEQ ID NO:320) | 795 | 870 |
| T46984_PEA_1_T23 (SEQ ID NO:321) | 795 | 870 |
| T46984_PEA_1_T27 (SEQ ID NO:322) | 613 | 688 |
| T46984_PEA_1_T32 (SEQ ID NO:323) | 619 | 694 |
| T46984_PEA_1_T34 (SEQ ID NO:324) | 795 | 870 |
| T46984_PEA_1_T35 (SEQ ID NO:325) | 523 | 598 |
| T46984_PEA_1_T40 (SEQ ID NO:326) | 795 | 870 |
| T46984_PEA_1_T42 (SEQ ID NO:327) | 795 | 870 |
| T46984_PEA_1_T43 (SEQ ID NO:328) | 795 | 870 |

Segment cluster T46984_PEA_1_node_21 (SEQ ID NO: 353) according to the present invention is supported by 242 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T40 (SEQ ID NO: 326), T46984_PEA_1_T42 (SEQ ID NO: 327) and T46984_PEA_1_T43 (SEQ ID NO: 328). Table 66 below describes the starting and ending position of this segment on each transcript.

TABLE 66

Segment location on transcripts

| Transcript name | Segment starting position | Segment ending position |
|---|---|---|
| T46984_PEA_1_T2 (SEQ ID NO:314) | 871 | 975 |
| T46984_PEA_1_T3 (SEQ ID NO:315) | 871 | 975 |
| T46984_PEA_1_T12 (SEQ ID NO:316) | 871 | 975 |
| T46984_PEA_1_T13 (SEQ ID NO:317) | 871 | 975 |
| T46984_PEA_1_T14 (SEQ ID NO:318) | 871 | 975 |
| T46984_PEA_1_T15 (SEQ ID NO:319) | 871 | 975 |
| T46984_PEA_1_T19 (SEQ ID NO:320) | 871 | 975 |
| T46984_PEA_1_T23 (SEQ ID NO:321) | 871 | 975 |
| T46984_PEA_1_T27 (SEQ ID NO:322) | 689 | 793 |
| T46984_PEA_1_T32 (SEQ ID NO:323) | 695 | 799 |
| T46984_PEA_1_T34 (SEQ ID NO:324) | 871 | 975 |
| T46984_PEA_1_T35 (SEQ ID NO:325) | 599 | 703 |
| T46984_PEA_1_T40 (SEQ ID NO:326) | 871 | 975 |
| T46984_PEA_1_T42 (SEQ ID NO:327) | 871 | 975 |
| T46984_PEA_1_T43 (SEQ ID NO:328) | 871 | 975 |

Segment cluster T46984_PEA_1_node_22 (SEQ ID NO: 354) according to the present invention is supported by 205 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T40 (SEQ ID NO: 326), T46984_PEA_1_T42 (SEQ ID NO: 327) and T46984_PEA_1_T43 (SEQ ID NO: 328). Table 67 below describes the starting and ending position of this segment on each transcript.

TABLE 67

Segment location on transcripts

| Transcript name | Segment starting position | Segment ending position |
|---|---|---|
| T46984_PEA_1_T2 (SEQ ID NO:314) | 976 | 1005 |
| T46984_PEA_1_T3 (SEQ ID NO:315) | 976 | 1005 |
| T46984_PEA_1_T12 (SEQ ID NO:316) | 976 | 1005 |
| T46984_PEA_1_T13 (SEQ ID NO:317) | 976 | 1005 |
| T46984_PEA_1_T14 (SEQ ID NO:318) | 976 | 1005 |
| T46984_PEA_1_T15 (SEQ ID NO:319) | 976 | 1005 |
| T46984_PEA_1_T19 (SEQ ID NO:320) | 976 | 1005 |
| T46984_PEA_1_T23 (SEQ ID NO:321) | 976 | 1005 |
| T46984_PEA_1_T27 (SEQ ID NO:322) | 794 | 823 |
| T46984_PEA_1_T32 (SEQ ID NO:323) | 800 | 829 |
| T46984_PEA_1_T34 (SEQ ID NO:324) | 976 | 1005 |
| T46984_PEA_1_T35 (SEQ ID NO:325) | 704 | 733 |
| T46984_PEA_1_T40 (SEQ ID NO:326) | 976 | 1005 |
| T46984_PEA_1_T42 (SEQ ID NO:327) | 976 | 1005 |
| T46984_PEA_1_T43 (SEQ ID NO:328) | 976 | 1005 |

Segment cluster T46984_PEA_1_node_26 (SEQ ID NO: 355) according to the present invention can be found in the following transcript(s): T46984_PEA_1_T2 (SEQ ID NO:

314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T40 (SEQ ID NO: 326) and T46984_PEA_1_T42 (SEQ ID NO: 327). Table 68 below describes the starting and ending position of this segment on each transcript.

TABLE 68

Segment location on transcripts

| Transcript name | Segment starting position | Segment ending position |
|---|---|---|
| T46984_PEA_1_T2 (SEQ ID NO:314) | 1172 | 1182 |
| T46984_PEA_1_T3 (SEQ ID NO:315) | 1172 | 1182 |
| T46984_PEA_1_T12 (SEQ ID NO:316) | 1172 | 1182 |
| T46984_PEA_1_T13 (SEQ ID NO:317) | 1172 | 1182 |
| T46984_PEA_1_T14 (SEQ ID NO:318) | 1172 | 1182 |
| T46984_PEA_1_T15 (SEQ ID NO:319) | 1172 | 1182 |
| T46984_PEA_1_T19 (SEQ ID NO:320) | 1172 | 1182 |
| T46984_PEA_1_T23 (SEQ ID NO:321) | 1172 | 1182 |
| T46984_PEA_1_T27 (SEQ ID NO:322) | 990 | 1000 |
| T46984_PEA_1_T32 (SEQ ID NO:323) | 996 | 1006 |
| T46984_PEA_1_T34 (SEQ ID NO:324) | 1172 | 1182 |
| T46984_PEA_1_T35 (SEQ ID NO:325) | 900 | 910 |
| T46984_PEA_1_T40 (SEQ ID NO:326) | 1172 | 1182 |
| T46984_PEA_1_T42 (SEQ ID NO:327) | 1172 | 1182 |

Segment cluster T46984_PEA_1_node_28 (SEQ ID NO: 356) according to the present invention is supported by 242 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T40 (SEQ ID NO: 326) and T46984_PEA_1_T42 (SEQ ID NO: 327). Table 69 below describes the starting and ending position of this segment on each transcript.

TABLE 69

Segment location on transcripts

| Transcript name | Segment starting position | Segment ending position |
|---|---|---|
| T46984_PEA_1_T2 (SEQ ID NO:314) | 1183 | 1301 |
| T46984_PEA_1_T3 (SEQ ID NO:315) | 1183 | 1301 |
| T46984_PEA_1_T12 (SEQ ID NO:316) | 1183 | 1301 |
| T46984_PEA_1_T13 (SEQ ID NO:317) | 1183 | 1301 |
| T46984_PEA_1_T14 (SEQ ID NO:318) | 1183 | 1301 |
| T46984_PEA_1_T15 (SEQ ID NO:319) | 1183 | 1301 |
| T46984_PEA_1_T19 (SEQ ID NO:320) | 1183 | 1301 |
| T46984_PEA_1_T23 (SEQ ID NO:321) | 1183 | 1301 |
| T46984_PEA_1_T27 (SEQ ID NO:322) | 1001 | 1119 |
| T46984_PEA_1_T32 (SEQ ID NO:323) | 1007 | 1125 |
| T46984_PEA_1_T34 (SEQ ID NO:324) | 1183 | 1301 |
| T46984_PEA_1_T35 (SEQ ID NO:325) | 911 | 1029 |
| T46984_PEA_1_T40 (SEQ ID NO:326) | 1183 | 1301 |
| T46984_PEA_1_T42 (SEQ ID NO:327) | 1183 | 1301 |

Segment cluster T46984_PEA_1_node_31 (SEQ ID NO: 357) according to the present invention is supported by 207 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325) and T46984_PEA_1_T40 (SEQ ID NO: 326). Table 70 below describes the starting and ending position of this segment on each transcript.

TABLE 70

Segment location on transcripts

| Transcript name | Segment starting position | Segment ending position |
|---|---|---|
| T46984_PEA_1_T2 (SEQ ID NO:314) | 1302 | 1329 |
| T46984_PEA_1_T3 (SEQ ID NO:315) | 1302 | 1329 |
| T46984_PEA_1_T12 (SEQ ID NO:316) | 1302 | 1329 |
| T46984_PEA_1_T13 (SEQ ID NO:317) | 1302 | 1329 |
| T46984_PEA_1_T14 (SEQ ID NO:318) | 1302 | 1329 |
| T46984_PEA_1_T15 (SEQ ID NO:319) | 1302 | 1329 |
| T46984_PEA_1_T19 (SEQ ID NO:320) | 1302 | 1329 |

TABLE 70-continued

Segment location on transcripts

| Transcript name | Segment starting position | Segment ending position |
|---|---|---|
| T46984_PEA_1_T23 (SEQ ID NO:321) | 1302 | 1329 |
| T46984_PEA_1_T27 (SEQ ID NO:322) | 1120 | 1147 |
| T46984_PEA_1_T32 (SEQ ID NO:323) | 1126 | 1153 |
| T46984_PEA_1_T34 (SEQ ID NO:324) | 1302 | 1329 |
| T46984_PEA_1_T35 (SEQ ID NO:325) | 1030 | 1057 |
| T46984_PEA_1_T40 (SEQ ID NO:326) | 1302 | 1329 |

Segment cluster T46984_PEA_1_node_32 (SEQ ID NO: 358) according to the present invention is supported by 226 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325) and T46984_PEA_1_T40 (SEQ ID NO: 326). Table 71 below describes the starting and ending position of this segment on each transcript.

TABLE 71

Segment location on transcripts

| Transcript name | Segment starting position | Segment ending position |
|---|---|---|
| T46984_PEA_1_T2 (SEQ ID NO:314) | 1330 | 1407 |
| T46984_PEA_1_T3 (SEQ ID NO:315) | 1330 | 1407 |
| T46984_PEA_1_T12 (SEQ ID NO:316) | 1330 | 1407 |
| T46984_PEA_1_T13 (SEQ ID NO:317) | 1330 | 1407 |
| T46984_PEA_1_T14 (SEQ ID NO:318) | 1330 | 1407 |
| T46984_PEA_1_T19 (SEQ ID NO:320) | 1330 | 1407 |
| T46984_PEA_1_T23 (SEQ ID NO:321) | 1330 | 1407 |
| T46984_PEA_1_T27 (SEQ ID NO:322) | 1148 | 1225 |
| T46984_PEA_1_T32 (SEQ ID NO:323) | 1154 | 1231 |
| T46984_PEA_1_T34 (SEQ ID NO:324) | 1330 | 1407 |
| T46984_PEA_1_T35 (SEQ ID NO:325) | 1058 | 1135 |
| T46984_PEA_1_T40 (SEQ ID NO:326) | 1330 | 1407 |

Segment cluster T46984_PEA_1_node_38 (SEQ ID NO: 359) according to the present invention can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324) and T46984_PEA_1_T35 (SEQ ID NO: 325). Table 72 below describes the starting and ending position of this segment on each transcript.

TABLE 72

Segment location on transcripts

| Transcript name | Segment starting position | Segment ending position |
|---|---|---|
| T46984_PEA_1_T2 (SEQ ID NO:314) | 1408 | 1412 |
| T46984_PEA_1_T3 (SEQ ID NO:315) | 1408 | 1412 |
| T46984_PEA_1_T12 (SEQ ID NO:316) | 1408 | 1412 |
| T46984_PEA_1_T13 (SEQ ID NO:317) | 1408 | 1412 |
| T46984_PEA_1_T14 (SEQ ID NO:318) | 1408 | 1412 |
| T46984_PEA_1_T19 (SEQ ID NO:320) | 1408 | 1412 |
| T46984_PEA_1_T23 (SEQ ID NO:321) | 1408 | 1412 |
| T46984_PEA_1_T27 (SEQ ID NO:322) | 1226 | 1230 |
| T46984_PEA_1_T32 (SEQ ID NO:323) | 1232 | 1236 |
| T46984_PEA_1_T34 (SEQ ID NO:324) | 1408 | 1412 |
| T46984_PEA_1_T35 (SEQ ID NO:325) | 1136 | 1140 |

Segment cluster T46984_PEA_1_node_39 (SEQ ID NO: 360) according to the present invention can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324) and T46984_PEA_1_T35 (SEQ ID NO: 325). Table 73 below describes the starting and ending position of this segment on each transcript.

TABLE 73

Segment location on transcripts

| Transcript name | Segment starting position | Segment ending position |
|---|---|---|
| T46984_PEA_1_T2 (SEQ ID NO:314) | 1413 | 1435 |
| T46984_PEA_1_T3 (SEQ ID NO:315) | 1413 | 1435 |
| T46984_PEA_1_T12 (SEQ ID NO:316) | 1413 | 1435 |
| T46984_PEA_1_T13 (SEQ ID NO:317) | 1413 | 1435 |
| T46984_PEA_1_T14 (SEQ ID NO:318) | 1413 | 1435 |
| T46984_PEA_1_T15 (SEQ ID NO:319) | 1330 | 1352 |
| T46984_PEA_1_T19 (SEQ ID NO:320) | 1413 | 1435 |
| T46984_PEA_1_T23 (SEQ ID NO:321) | 1413 | 1435 |

TABLE 73-continued

Segment location on transcripts

| Transcript name | Segment starting position | Segment ending position |
|---|---|---|
| T46984_PEA_1_T27 (SEQ ID NO:322) | 1231 | 1253 |
| T46984_PEA_1_T32 (SEQ ID NO:323) | 1237 | 1259 |
| T46984_PEA_1_T34 (SEQ ID NO:324) | 1413 | 1435 |
| T46984_PEA_1_T35 (SEQ ID NO:325) | 1141 | 1163 |

Segment cluster T46984_PEA_1_node_40 (SEQ ID NO: 361) according to the present invention is supported by 227 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324) and T46984_PEA_1_T35 (SEQ ID NO: 325). Table 74 below describes the starting and ending position of this segment on each transcript.

TABLE 74

Segment location on transcripts

| Transcript name | Segment starting position | Segment ending position |
|---|---|---|
| T46984_PEA_1_T2 (SEQ ID NO:314) | 1436 | 1499 |
| T46984_PEA_1_T3 (SEQ ID NO:315) | 1436 | 1499 |
| T46984_PEA_1_T12 (SEQ ID NO:316) | 1436 | 1499 |
| T46984_PEA_1_T13 (SEQ ID NO:317) | 1436 | 1499 |
| T46984_PEA_1_T14 (SEQ ID NO:318) | 1436 | 1499 |
| T46984_PEA_1_T15 (SEQ ID NO:319) | 1353 | 1416 |
| T46984_PEA_1_T19 (SEQ ID NO:320) | 1436 | 1499 |
| T46984_PEA_1_T23 (SEQ ID NO:321) | 1436 | 1499 |
| T46984_PEA_1_T27 (SEQ ID NO:322) | 1254 | 1317 |
| T46984_PEA_1_T32 (SEQ ID NO:323) | 1260 | 1323 |
| T46984_PEA_1_T34 (SEQ ID NO:324) | 1436 | 1499 |
| T46984_PEA_1_T35 (SEQ ID NO:325) | 1164 | 1227 |

Segment cluster T46984_PEA_1_node_42 (SEQ ID NO: 362) according to the present invention is supported by 239 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324) and T46984_PEA_1_T35 (SEQ ID NO: 325). Table 75 below describes the starting and ending position of this segment on each transcript.

TABLE 75

Segment location on transcripts

| Transcript name | Segment starting position | Segment ending position |
|---|---|---|
| T46984_PEA_1_T2 (SEQ ID NO:314) | 1500 | 1562 |
| T46984_PEA_1_T3 (SEQ ID NO:315) | 1500 | 1562 |
| T46984_PEA_1_T12 (SEQ ID NO:316) | 1500 | 1562 |
| T46984_PEA_1_T13 (SEQ ID NO:317) | 1500 | 1562 |
| T46984_PEA_1_T14 (SEQ ID NO:318) | 1500 | 1562 |
| T46984_PEA_1_T15 (SEQ ID NO:319) | 1417 | 1479 |
| T46984_PEA_1_T19 (SEQ ID NO:320) | 1500 | 1562 |
| T46984_PEA_1_T23 (SEQ ID NO:321) | 1500 | 1562 |
| T46984_PEA_1_T27 (SEQ ID NO:322) | 1318 | 1380 |
| T46984_PEA_1_T32 (SEQ ID NO:323) | 1324 | 1386 |
| T46984_PEA_1_T34 (SEQ ID NO:324) | 1500 | 1562 |
| T46984_PEA_1_T35 (SEQ ID NO:325) | 1228 | 1290 |

Segment cluster T46984_PEA_1_node_43 (SEQ ID NO: 363) according to the present invention is supported by 235 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323) and T46984_PEA_1_T35 (SEQ ID NO: 325). Table 76 below describes the starting and ending position of this segment on each transcript.

TABLE 76

Segment location on transcripts

| Transcript name | Segment starting position | Segment ending position |
|---|---|---|
| T46984_PEA_1_T2 (SEQ ID NO:314) | 1563 | 1614 |
| T46984_PEA_1_T3 (SEQ ID NO:315) | 1563 | 1614 |
| T46984_PEA_1_T12 (SEQ ID NO:316) | 1563 | 1614 |
| T46984_PEA_1_T13 (SEQ ID NO:317) | 1563 | 1614 |
| T46984_PEA_1_T14 (SEQ ID NO:318) | 1563 | 1614 |
| T46984_PEA_1_T15 (SEQ ID NO:319) | 1480 | 1531 |
| T46984_PEA_1_T19 (SEQ ID NO:320) | 1563 | 1614 |

TABLE 76-continued

Segment location on transcripts

| Transcript name | Segment starting position | Segment ending position |
|---|---|---|
| T46984_PEA_1_T23 (SEQ ID NO:321) | 1563 | 1614 |
| T46984_PEA_1_T27 (SEQ ID NO:322) | 1381 | 1432 |
| T46984_PEA_1_T32 (SEQ ID NO:323) | 1387 | 1438 |
| T46984_PEA_1_T35 (SEQ ID NO:325) | 1291 | 1342 |

Segment cluster T46984_PEA_1_node_48 (SEQ ID NO: 364) according to the present invention is supported by 282 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T35 (SEQ ID NO: 325) and T46984_PEA_1_T46 (SEQ ID NO: 329). Table 77 below describes the starting and ending position of this segment on each transcript.

TABLE 77

Segment location on transcripts

| Transcript name | Segment starting position | Segment ending position |
|---|---|---|
| T46984_PEA_1_T2 (SEQ ID NO:314) | 1615 | 1715 |
| T46984_PEA_1_T3 (SEQ ID NO:315) | 2243 | 2343 |
| T46984_PEA_1_T12 (SEQ ID NO:316) | 1615 | 1715 |
| T46984_PEA_1_T13 (SEQ ID NO:317) | 1615 | 1715 |
| T46984_PEA_1_T14 (SEQ ID NO:318) | 1615 | 1715 |
| T46984_PEA_1_T15 (SEQ ID NO:319) | 1532 | 1632 |
| T46984_PEA_1_T19 (SEQ ID NO:320) | 2243 | 2343 |
| T46984_PEA_1_T23 (SEQ ID NO:321) | 1615 | 1715 |
| T46984_PEA_1_T27 (SEQ ID NO:322) | 1433 | 1533 |
| T46984_PEA_1_T32 (SEQ ID NO:323) | 1439 | 1539 |
| T46984_PEA_1_T35 (SEQ ID NO:325) | 1343 | 1443 |
| T46984_PEA_1_T46 (SEQ ID NO:329) | 935 | 1035 |

Segment cluster T46984_PEA_1_node_49 (SEQ ID NO: 365) according to the present invention is supported by 262 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T35 (SEQ ID NO: 325) and T46984_PEA_1_T46 (SEQ ID NO: 329). Table 78 below describes the starting and ending position of this segment on each transcript.

TABLE 78

Segment location on transcripts

| Transcript name | Segment starting position | Segment ending position |
|---|---|---|
| T46984_PEA_1_T2 (SEQ ID NO:314) | 1716 | 1757 |
| T46984_PEA_1_T3 (SEQ ID NO:315) | 2344 | 2385 |
| T46984_PEA_1_T12 (SEQ ID NO:316) | 1716 | 1757 |
| T46984_PEA_1_T13 (SEQ ID NO:317) | 1716 | 1757 |
| T46984_PEA_1_T14 (SEQ ID NO:318) | 1716 | 1757 |
| T46984_PEA_1_T15 (SEQ ID NO:319) | 1633 | 1674 |
| T46984_PEA_1_T19 (SEQ ID NO:320) | 2344 | 2385 |
| T46984_PEA_1_T23 (SEQ ID NO:321) | 1716 | 1757 |
| T46984_PEA_1_T27 (SEQ ID NO:322) | 1534 | 1575 |
| T46984_PEA_1_T32 (SEQ ID NO:323) | 1540 | 1581 |
| T46984_PEA_1_T35 (SEQ ID NO:325) | 1444 | 1485 |
| T46984_PEA_1_T46 (SEQ ID NO:329) | 1036 | 1077 |

Segment cluster T46984_PEA_1_node_50 (SEQ ID NO: 366) according to the present invention is supported by 277 libraries. The number of libraries was determined as previously described. This segment can be found in the following transcript(s): T46984_PEA_1_T2 (SEQ ID NO: 314), T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T35 (SEQ ID NO: 325) and T46984_PEA_1_T46 (SEQ ID NO: 329). Table 79 below describes the starting and ending position of this segment on each transcript.

TABLE 79

Segment location on transcripts

| Transcript name | Segment starting position | Segment ending position |
|---|---|---|
| T46984_PEA_1_T2 (SEQ ID NO:314) | 1758 | 1809 |
| T46984_PEA_1_T3 (SEQ ID NO:315) | 2386 | 2437 |
| T46984_PEA_1_T12 (SEQ ID NO:316) | 1758 | 1809 |
| T46984_PEA_1_T13 (SEQ ID NO:317) | 1758 | 1809 |
| T46984_PEA_1_T14 (SEQ ID NO:318) | 1758 | 1809 |
| T46984_PEA_1_T15 (SEQ ID NO:319) | 1675 | 1726 |
| T46984_PEA_1_T19 (SEQ ID NO:320) | 2386 | 2437 |

TABLE 79-continued

Segment location on transcripts

| Transcript name | Segment starting position | Segment ending position |
|---|---|---|
| T46984_PEA_1_T23 (SEQ ID NO:321) | 1758 | 1809 |
| T46984_PEA_1_T27 (SEQ ID NO:322) | 1576 | 1627 |
| T46984_PEA_1_T32 (SEQ ID NO:323) | 1582 | 1633 |
| T46984_PEA_1_T35 (SEQ ID NO:325) | 1486 | 1537 |
| T46984_PEA_1_T46 (SEQ ID NO:329) | 1078 | 1129 |

Segment cluster T46984_PEA_1_node_51 (SEQ ID NO: 367) according to the present invention is supported by 6 libraries. The number of libraries was determined as previously described. This segment can be found in the following transcript(s): T46984_PEA_1_T2 (SEQ ID NO: 314), T46984_PEA_1_T12 (SEQ ID NO: 316), T46984_PEA_1_T19 (SEQ ID NO: 320) and T46984_PEA_1_T23 (SEQ ID NO: 321). Table 80 below describes the starting and ending position of this segment on each transcript.

TABLE 80

Segment location on transcripts

| Transcript name | Segment starting position | Segment ending position |
|---|---|---|
| T46984_PEA_1_T2 (SEQ ID NO: 314) | 1810 | 1837 |
| T46984_PEA_1_T12 (SEQ ID NO: 316) | 1810 | 1837 |
| T46984_PEA_1_T19 (SEQ ID NO: 320) | 2438 | 2465 |
| T46984_PEA_1_T23 (SEQ ID NO: 321) | 1810 | 1837 |

Segment cluster T46984_PEA_1_node_53 (SEQ ID NO: 368) according to the present invention is supported by 16 libraries. The number of libraries was determined as previously described. This segment can be found in the following transcript(s): T46984_PEA_1_T2 (SEQ ID NO: 314), T46984_PEA_1_T13 (SEQ ID NO: 317), T46984_PEA_1_T19 (SEQ ID NO: 320) and T46984_PEA_1_T23 (SEQ ID NO: 321). Table 81 below describes the starting and ending position of this segment on each transcript.

TABLE 81

Segment location on transcripts

| Transcript name | Segment starting position | Segment ending position |
|---|---|---|
| T46984_PEA_1_T2 (SEQ ID NO: 314) | 2905 | 2963 |
| T46984_PEA_1_T13 (SEQ ID NO: 317) | 1810 | 1868 |
| T46984_PEA_1_T19 (SEQ ID NO: 320) | 3533 | 3591 |
| T46984_PEA_1_T23 (SEQ ID NO: 321) | 2905 | 2963 |

Segment cluster T46984_PEA_1_node_54 (SEQ ID NO: 369) according to the present invention is supported by 18 libraries. The number of libraries was determined as previously described. This segment can be found in the following transcript(s): T46984_PEA_1_T2 (SEQ ID NO: 314), T46984_PEA_1_T19 (SEQ ID NO: 320) and T46984_PEA_1_T23 (SEQ ID NO: 321). Table 82 below describes the starting and ending position of this segment on each transcript.

TABLE 82

Segment location on transcripts

| Transcript name | Segment starting position | Segment ending position |
|---|---|---|
| T46984_PEA_1_T2 | 2964 | 3043 |
| T46984_PEA_1_T19 (SEQ ID NO: 320) | 3592 | 3671 |
| T46984_PEA_1_T23 (SEQ ID NO: 321) | 2964 | 3043 |

Segment cluster T46984_PEA_1_node_55 (SEQ ID NO: 370) according to the present invention is supported by 335 libraries. The number of libraries was determined as previously described. This segment can be found in the following transcript(s): T46984_PEA_1_T2, T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T35 (SEQ ID NO: 325) and T46984_PEA_1_T46 (SEQ ID NO: 329). Table 83 below describes the starting and ending position of this segment on each transcript.

TABLE 83

Segment location on transcripts

| Transcript name | Segment starting position | Segment ending position |
|---|---|---|
| T46984_PEA_1_T2 | 3044 | 3110 |
| T46984_PEA_1_T3 (SEQ ID NO: 315) | 2438 | 2504 |
| T46984_PEA_1_T12 (SEQ ID NO: 316) | 1838 | 1904 |
| T46984_PEA_1_T13 (SEQ ID NO: 317) | 1869 | 1935 |
| T46984_PEA_1_T14 (SEQ ID NO: 318) | 1810 | 1876 |
| T46984_PEA_1_T15 (SEQ ID NO: 319) | 1727 | 1793 |
| T46984_PEA_1_T19 (SEQ ID NO: 320) | 3672 | 3738 |
| T46984_PEA_1_T23 (SEQ ID NO: 321) | 3044 | 3110 |
| T46984_PEA_1_T27 (SEQ ID NO: 322) | 1628 | 1694 |
| T46984_PEA_1_T32 (SEQ ID NO: 323) | 1634 | 1700 |
| T46984_PEA_1_T35 (SEQ ID NO: 325) | 1538 | 1604 |
| T46984_PEA_1_T46 (SEQ ID NO: 329) | 1130 | 1196 |

Segment cluster T46984_PEA_1_node_57 (SEQ ID NO: 371) according to the present invention can be found in the following transcript(s): T46984_PEA_1_T2, T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_

1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T35 (SEQ ID NO: 325) and T46984_PEA_1_T46 (SEQ ID NO: 329). Table 84 below describes the starting and ending position of this segment on each transcript.

TABLE 84

Segment location on transcripts

| Transcript name | Segment starting position | Segment ending position |
|---|---|---|
| T46984_PEA_1_T2 | 3111 | 3130 |
| T46984_PEA_1_T3 (SEQ ID NO: 315) | 2505 | 2524 |
| T46984_PEA_1_T12 (SEQ ID NO: 316) | 1905 | 1924 |
| T46984_PEA_1_T13 (SEQ ID NO: 317) | 1936 | 1955 |
| T46984_PEA_1_T14 (SEQ ID NO: 318) | 1877 | 1896 |
| T46984_PEA_1_T15 (SEQ ID NO: 319) | 1794 | 1813 |
| T46984_PEA_1_T19 (SEQ ID NO: 320) | 3739 | 3758 |
| T46984_PEA_1_T23 (SEQ ID NO: 321) | 3111 | 3130 |
| T46984_PEA_1_T27 (SEQ ID NO: 322) | 1695 | 1714 |
| T46984_PEA_1_T32 (SEQ ID NO: 323) | 1701 | 1720 |
| T46984_PEA_1_T35 (SEQ ID NO: 325) | 1605 | 1624 |
| T46984_PEA_1_T46 (SEQ ID NO: 329) | 1197 | 1216 |

Segment cluster T46984_PEA_1_node_6 (SEQ ID NO: 337)0 according to the present invention is supported by 326 libraries. The number of libraries was determined as previously described. This segment can be found in the following transcript(s): T46984_PEA_1_T2, T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T27 (SEQ ID NO: 322), T46984_PEA_1_T32 (SEQ ID NO: 323), T46984_PEA_1_T35 (SEQ ID NO: 325) and T46984_PEA_1_T46 (SEQ ID NO: 329). Table 85 below describes the starting and ending position of this segment on each transcript.

TABLE 85

Segment location on transcripts

| Transcript name | Segment starting position | Segment ending position |
|---|---|---|
| T46984_PEA_1_T2 | 3131 | 3165 |
| T46984_PEA_1_T3 (SEQ ID NO: 315) | 2525 | 2559 |
| T46984_PEA_1_T12 (SEQ ID NO: 316) | 1925 | 1959 |
| T46984_PEA_1_T13 (SEQ ID NO: 317) | 1956 | 1990 |
| T46984_PEA_1_T14 (SEQ ID NO: 318) | 1897 | 1931 |
| T46984_PEA_1_T15 (SEQ ID NO: 319) | 1814 | 1848 |
| T46984_PEA_1_T19 (SEQ ID NO: 320) | 3759 | 3793 |
| T46984_PEA_1_T27 (SEQ ID NO: 322) | 1715 | 1749 |

TABLE 85-continued

Segment location on transcripts

| Transcript name | Segment starting position | Segment ending position |
|---|---|---|
| T46984_PEA_1_T32 (SEQ ID NO: 323) | 1721 | 1755 |
| T46984_PEA_1_T35 (SEQ ID NO: 325) | 1625 | 1659 |
| T46984_PEA_1_T46 (SEQ ID NO: 329) | 1217 | 1251 |

Segment cluster T46984_PEA_1_node_62 (SEQ ID NO: 373) according to the present invention is supported by 335 libraries. The number of libraries was determined as previously described. This segment can be found in the following transcript(s): T46984_PEA_1_T2, T46984_PEA_1_T3 (SEQ ID NO: 315), T46984_PEA_1_T12 (SEQ ID NO: 316), T46984_PEA_1_T13 (SEQ ID NO:317), T46984_PEA_1_T14 (SEQ ID NO:318), T46984_PEA_1_T15 (SEQ ID NO: 319), T46984_PEA_1_T19 (SEQ ID NO: 320), T46984_PEA_1_T27 (SEQ ID NO: 322), T46984_PEA_1_T32 (SEQ ID NO: 323), T46984_PEA_1_T35 (SEQ ID NO: 325) and T46984_PEA_1_T46 (SEQ ID NO: 329). Table 86 below describes the starting and ending position of this segment on each transcript.

TABLE 86

Segment location on transcripts

| Transcript name | Segment starting position | Segment ending position |
|---|---|---|
| T46984_PEA_1_T2 | 3166 | 3226 |
| T46984_PEA_1_T3 (SEQ ID NO: 315) | 2560 | 2620 |
| T46984_PEA_1_T12 (SEQ ID NO: 316) | 1960 | 2020 |
| T46984_PEA_1_T13 (SEQ ID NO: 317) | 1991 | 2051 |
| T46984_PEA_1_T14 (SEQ ID NO: 318) | 1932 | 1992 |
| T46984_PEA_1_T15 (SEQ ID NO: 319) | 1849 | 1909 |
| T46984_PEA_1_T19 (SEQ ID NO: 320) | 3794 | 3854 |
| T46984_PEA_1_T27 (SEQ ID NO: 322) | 1750 | 1810 |
| T46984_PEA_1_T32 (SEQ ID NO: 323) | 1756 | 1816 |
| T46984_PEA_1_T35 (SEQ ID NO: 325) | 1660 | 1720 |
| T46984_PEA_1_T46 (SEQ ID NO: 329) | 1252 | 1312 |

Segment cluster T46984_PEA_1_node_6 (SEQ ID NO: 337)6 according to the present invention is supported by 336 libraries. The number of libraries was determined as previously described. This segment can be found in the following transcript(s): T46984_PEA_1_T2, T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T46 (SEQ ID NO: 329), T46984_PEA_1_T47 (SEQ ID NO: 330) and T46984_PEA_1_T51 (SEQ ID NO: 332). Table 87 below describes the starting and ending position of this segment on each transcript.

TABLE 87

Segment location on transcripts

| Transcript name | Segment starting position | Segment ending position |
|---|---|---|
| T46984_PEA_1_T2 | 3227 | 3261 |
| T46984_PEA_1_T3 (SEQ ID NO: 315) | 2621 | 2655 |
| T46984_PEA_1_T12 (SEQ ID NO: 316) | 2021 | 2055 |
| T46984_PEA_1_T13 (SEQ ID NO: 317) | 2052 | 2086 |
| T46984_PEA_1_T14 (SEQ ID NO: 318) | 1993 | 2027 |
| T46984_PEA_1_T15 (SEQ ID NO: 319) | 1910 | 1944 |
| T46984_PEA_1_T19 (SEQ ID NO: 320) | 3855 | 3889 |
| T46984_PEA_1_T23 (SEQ ID NO: 321) | 3131 | 3165 |
| T46984_PEA_1_T27 (SEQ ID NO: 322) | 1811 | 1845 |
| T46984_PEA_1_T32 (SEQ ID NO: 323) | 1817 | 1851 |
| T46984_PEA_1_T34 (SEQ ID NO: 324) | 1563 | 1597 |
| T46984_PEA_1_T35 (SEQ ID NO: 325) | 1721 | 1755 |
| T46984_PEA_1_T46 (SEQ ID NO: 329) | 1313 | 1347 |
| T46984_PEA_1_T47 (SEQ ID NO: 330) | 752 | 786 |
| T46984_PEA_1_T51 (SEQ ID NO: 332) | 349 | 383 |

Segment cluster T46984_PEA_1_node_6 (SEQ ID NO: 337)7 according to the present invention is supported by 323 libraries. The number of libraries was determined as previously described. This segment can be found in the following transcript(s): T46984_PEA_1_T2, T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T46 (SEQ ID NO: 329), T46984_PEA_1_T47 (SEQ ID NO: 330) and T46984_PEA_1_T51 (SEQ ID NO: 332). Table 88 below describes the starting and ending position of this segment on each transcript.

TABLE 88

Segment location on transcripts

| Transcript name | Segment starting position | Segment ending position |
|---|---|---|
| T46984_PEA_1_T2 | 3262 | 3302 |
| T46984_PEA_1_T3 (SEQ ID NO: 315) | 2656 | 2696 |
| T46984_PEA_1_T12 (SEQ ID NO: 316) | 2056 | 2096 |
| T46984_PEA_1_T13 (SEQ ID NO: 317) | 2087 | 2127 |
| T46984_PEA_1_T14 (SEQ ID NO: 318) | 2028 | 2068 |
| T46984_PEA_1_T15 (SEQ ID NO: 319) | 1945 | 1985 |

TABLE 88-continued

Segment location on transcripts

| Transcript name | Segment starting position | Segment ending position |
|---|---|---|
| T46984_PEA_1_T19 (SEQ ID NO: 320) | 3890 | 3930 |
| T46984_PEA_1_T23 (SEQ ID NO: 321) | 3166 | 3206 |
| T46984_PEA_1_T27 (SEQ ID NO: 322) | 1846 | 1886 |
| T46984_PEA_1_T32 (SEQ ID NO: 323) | 1852 | 1892 |
| T46984_PEA_1_T34 (SEQ ID NO: 324) | 1598 | 1638 |
| T46984_PEA_1_T35 (SEQ ID NO: 325) | 1756 | 1796 |
| T46984_PEA_1_T46 (SEQ ID NO: 329) | 1348 | 1388 |
| T46984_PEA_1_T47 (SEQ ID NO: 330) | 787 | 827 |
| T46984_PEA_1_T51 (SEQ ID NO: 332) | 384 | 424 |

Segment cluster T46984_PEA_1_node_70 (SEQ ID NO: 376) according to the present invention is supported by 337 libraries. The number of libraries was determined as previously described. This segment can be found in the following transcript(s): T46984_PEA_1_T2, T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T46 (SEQ ID NO: 329), T46984_PEA_1_T47 (SEQ ID NO: 330), T46984_PEA_1_T51 (SEQ ID NO: 332), T46984_PEA_1_T52 (SEQ ID NO: 333) and T46984_PEA_1_T54 (SEQ ID NO: 334). Table 89 below describes the starting and ending position of this segment on each transcript.

TABLE 89

Segment location on transcripts

| Transcript name | Segment starting position | Segment ending position |
|---|---|---|
| T46984_PEA_1_T2 | 3303 | 3377 |
| T46984_PEA_1_T3 (SEQ ID NO: 315) | 2697 | 2771 |
| T46984_PEA_1_T12 (SEQ ID NO: 316) | 2097 | 2171 |
| T46984_PEA_1_T13 (SEQ ID NO: 317) | 2128 | 2202 |
| T46984_PEA_1_T14 (SEQ ID NO: 318) | 2069 | 2143 |
| T46984_PEA_1_T15 (SEQ ID NO: 319) | 1986 | 2060 |
| T46984_PEA_1_T19 (SEQ ID NO: 320) | 3931 | 4005 |
| T46984_PEA_1_T23 (SEQ ID NO: 321) | 3207 | 3281 |
| T46984_PEA_1_T27 (SEQ ID NO: 322) | 1887 | 1961 |
| T46984_PEA_1_T32 (SEQ ID NO: 323) | 1893 | 1967 |
| T46984_PEA_1_T34 (SEQ ID NO: 324) | 1639 | 1713 |

TABLE 89-continued

Segment location on transcripts

| Transcript name | Segment starting position | Segment ending position |
|---|---|---|
| T46984_PEA_1_T35 (SEQ ID NO: 325) | 1797 | 1871 |
| T46984_PEA_1_T46 (SEQ ID NO: 329) | 1389 | 1463 |
| T46984_PEA_1_T47 (SEQ ID NO: 330) | 828 | 902 |
| T46984_PEA_1_T51 (SEQ ID NO: 332) | 425 | 499 |
| T46984_PEA_1_T52 (SEQ ID NO: 333) | 928 | 1002 |
| T46984_PEA_1_T54 (SEQ ID NO: 334) | 928 | 1002 |

Segment cluster T46984_PEA_1_node_71 (SEQ ID NO: 377) according to the present invention can be found in the following transcript(s): T46984_PEA_1_T2, T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T46 (SEQ ID NO: 329), T46984_PEA_1_T47 (SEQ ID NO: 330), T46984_PEA_1_T51 (SEQ ID NO: 332), T46984_PEA_1_T52 (SEQ ID NO: 333) and T46984_PEA_1_T54 (SEQ ID NO: 334). Table 90 below describes the starting and ending position of this segment on each transcript.

TABLE 90

Segment location on transcripts

| Transcript name | Segment starting position | Segment ending position |
|---|---|---|
| T46984_PEA_1_T2 | 3378 | 3399 |
| T46984_PEA_1_T3 (SEQ ID NO: 315) | 2772 | 2793 |
| T46984_PEA_1_T12 (SEQ ID NO: 316) | 2172 | 2193 |
| T46984_PEA_1_T13 (SEQ ID NO: 317) | 2203 | 2224 |
| T46984_PEA_1_T14 (SEQ ID NO: 318) | 2144 | 2165 |
| T46984_PEA_1_T15 (SEQ ID NO: 319) | 2061 | 2082 |
| T46984_PEA_1_T19 (SEQ ID NO: 320) | 4006 | 4027 |
| T46984_PEA_1_T23 (SEQ ID NO: 321) | 3282 | 3303 |
| T46984_PEA_1_T27 (SEQ ID NO: 322) | 1962 | 1983 |
| T46984_PEA_1_T32 (SEQ ID NO: 323) | 1968 | 1989 |
| T46984_PEA_1_T34 (SEQ ID NO: 324) | 1714 | 1735 |
| T46984_PEA_1_T35 (SEQ ID NO: 325) | 1872 | 1893 |
| T46984_PEA_1_T46 (SEQ ID NO: 329) | 1464 | 1485 |
| T46984_PEA_1_T47 (SEQ ID NO: 330) | 903 | 924 |
| T46984_PEA_1_T51 (SEQ ID NO: 332) | 500 | 521 |

TABLE 90-continued

Segment location on transcripts

| Transcript name | Segment starting position | Segment ending position |
|---|---|---|
| T46984_PEA_1_T52 (SEQ ID NO: 333) | 1003 | 1024 |
| T46984_PEA_1_T54 (SEQ ID NO: 334) | 1003 | 1024 |

Segment cluster T46984_PEA_1_node_72 (SEQ ID NO: 378) according to the present invention can be found in the following transcript(s): T46984_PEA_1_T2, T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T43 (SEQ ID NO: 328), T46984_PEA_1_T46 (SEQ ID NO: 329), T46984_PEA_1_T47 (SEQ ID NO: 330), T46984_PEA_1_T51 (SEQ ID NO: 332), T46984_PEA_1_T52 (SEQ ID NO: 333) and T46984_PEA_1_T54 (SEQ ID NO: 334). Table 91 below describes the starting and ending position of this segment on each transcript.

TABLE 91

Segment location on transcripts

| Transcript name | Segment starting position | Segment ending position |
|---|---|---|
| T46984_PEA_1_T2 | 3400 | 3421 |
| T46984_PEA_1_T3 (SEQ ID NO: 315) | 2794 | 2815 |
| T46984_PEA_1_T12 (SEQ ID NO: 316) | 2194 | 2215 |
| T46984_PEA_1_T13 (SEQ ID NO: 317) | 2225 | 2246 |
| T46984_PEA_1_T14 (SEQ ID NO: 318) | 2166 | 2187 |
| T46984_PEA_1_T15 (SEQ ID NO: 319) | 2083 | 2104 |
| T46984_PEA_1_T19 (SEQ ID NO: 320) | 4028 | 4049 |
| T46984_PEA_1_T23 (SEQ ID NO: 321) | 3304 | 3325 |
| T46984_PEA_1_T27 (SEQ ID NO: 322) | 1984 | 2005 |
| T46984_PEA_1_T32 (SEQ ID NO: 323) | 1990 | 2011 |
| T46984_PEA_1_T34 (SEQ ID NO: 324) | 1736 | 1757 |
| T46984_PEA_1_T35 (SEQ ID NO: 325) | 1894 | 1915 |
| T46984_PEA_1_T43 (SEQ ID NO: 328) | 1172 | 1193 |
| T46984_PEA_1_T46 (SEQ ID NO: 329) | 1486 | 1507 |
| T46984_PEA_1_T47 (SEQ ID NO: 330) | 925 | 946 |
| T46984_PEA_1_T51 (SEQ ID NO: 332) | 522 | 543 |
| T46984_PEA_1_T52 (SEQ ID NO: 333) | 1025 | 1046 |
| T46984_PEA_1_T54 (SEQ ID NO: 334) | 1025 | 1046 |

Segment cluster T46984_PEA_1_node_73 (SEQ ID NO: 379) according to the present invention can be found in the following transcript(s): T46984_PEA_1_T2, T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T43 (SEQ ID NO: 328), T46984_PEA_1_T46 (SEQ ID NO: 329), T46984_PEA_1_T47 (SEQ ID NO: 330), T46984_PEA_1_T51 (SEQ ID NO: 332), T46984_PEA_1_T52 (SEQ ID NO: 333) and T46984_PEA_1_T54 (SEQ ID NO: 334). Table 92 below describes the starting and ending position of this segment on each transcript.

TABLE 92

Segment location on transcripts

| Transcript name | Segment starting position | Segment ending position |
| --- | --- | --- |
| T46984_PEA_1_T2 | 3422 | 3428 |
| T46984_PEA_1_T3 (SEQ ID NO: 315) | 2816 | 2822 |
| T46984_PEA_1_T12 (SEQ ID NO: 316) | 2216 | 2222 |
| T46984_PEA_1_T13 (SEQ ID NO: 317) | 2247 | 2253 |
| T46984_PEA_1_T14 (SEQ ID NO: 318) | 2188 | 2194 |
| T46984_PEA_1_T15 (SEQ ID NO: 319) | 2105 | 2111 |
| T46984_PEA_1_T19 (SEQ ID NO: 320) | 4050 | 4056 |
| T46984_PEA_1_T23 (SEQ ID NO: 321) | 3326 | 3332 |
| T46984_PEA_1_T27 (SEQ ID NO: 322) | 2006 | 2012 |
| T46984_PEA_1_T32 (SEQ ID NO: 323) | 2012 | 2018 |
| T46984_PEA_1_T34 (SEQ ID NO: 324) | 1758 | 1764 |
| T46984_PEA_1_T35 (SEQ ID NO: 325) | 1916 | 1922 |
| T46984_PEA_1_T43 (SEQ ID NO: 328) | 1194 | 1200 |
| T46984_PEA_1_T46 (SEQ ID NO: 329) | 1508 | 1514 |
| T46984_PEA_1_T47 (SEQ ID NO: 330) | 947 | 953 |
| T46984_PEA_1_T51 (SEQ ID NO: 332) | 544 | 550 |
| T46984_PEA_1_T52 (SEQ ID NO: 333) | 1047 | 1053 |
| T46984_PEA_1_T54 (SEQ ID NO: 334) | 1047 | 1053 |

Segment cluster T46984_PEA_1_node_74 (SEQ ID NO: 380) according to the present invention can be found in the following transcript(s): T46984_PEA_1_T2, T46984_PEA_1_T3 (SEQ ID NO: 315), T46984_PEA_1_T12 (SEQ ID NO: 316), T46984_PEA_1_T13 (SEQ ID NO: 317), T46984_PEA_1_T14 (SEQ ID NO: 318), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T43 (SEQ ID NO: 328), T46984_PEA_1_T46 (SEQ ID NO: 329), T46984_PEA_1_T47 (SEQ ID NO: 330), T46984_PEA_1_T51 (SEQ ID NO: 332), T46984_PEA_1_T52 (SEQ ID NO: 333) and T46984_PEA_1_T54 (SEQ ID NO: 334). Table 93 below describes the starting and ending position of this segment on each transcript.

TABLE 93

Segment location on transcripts

| Transcript name | Segment starting position | Segment ending position |
| --- | --- | --- |
| T46984_PEA_1_T2 | 3429 | 3432 |
| T46984_PEA_1_T3 (SEQ ID NO: 315) | 2823 | 2826 |
| T46984_PEA_1_T12 (SEQ ID NO: 316) | 2223 | 2226 |
| T46984_PEA_1_T13 (SEQ ID NO: 317) | 2254 | 2257 |
| T46984_PEA_1_T14 (SEQ ID NO: 318) | 2195 | 2198 |
| T46984_PEA_1_T15 (SEQ ID NO: 319) | 2112 | 2115 |
| T46984_PEA_1_T19 (SEQ ID NO: 320) | 4057 | 4060 |
| T46984_PEA_1_T23 (SEQ ID NO: 321) | 3333 | 3336 |
| T46984_PEA_1_T27 (SEQ ID NO: 322) | 2013 | 2016 |
| T46984_PEA_1_T32 (SEQ ID NO: 323) | 2019 | 2022 |
| T46984_PEA_1_T34 (SEQ ID NO: 324) | 1765 | 1768 |
| T46984_PEA_1_T35 (SEQ ID NO: 325) | 1923 | 1926 |
| T46984_PEA_1_T43 (SEQ ID NO: 328) | 1201 | 1204 |
| T46984_PEA_1_T46 (SEQ ID NO: 329) | 1515 | 1518 |
| T46984_PEA_1_T47 (SEQ ID NO: 330) | 954 | 957 |
| T46984_PEA_1_T51 (SEQ ID NO: 332) | 551 | 554 |
| T46984_PEA_1_T52 (SEQ ID NO: 333) | 1054 | 1057 |
| T46984_PEA_1_T54 (SEQ ID NO: 334) | 1054 | 1057 |

Segment cluster T46984_PEA_1_node_83 (SEQ ID NO: 381) according to the present invention can be found in the following transcript(s): T46984_PEA_1_T2, T46984_PEA_1_T3 (SEQ ID NO: 315), T46984_PEA_1_T12 (SEQ ID NO: 316), T46984_PEA_1_T13 (SEQ ID NO: 317), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T43 (SEQ ID NO: 328), T46984_PEA_1_T46 (SEQ ID NO: 329), T46984_PEA_1_T47 (SEQ ID NO: 330), T46984_PEA_1_T51 (SEQ ID NO: 332), T46984_PEA_1_T52 (SEQ ID NO: 333) and T46984_PEA_1_T54 (SEQ ID NO: 334). Table 94 below describes the starting and ending position of this segment on each transcript.

TABLE 94

Segment location on transcripts

| Transcript name | Segment starting position | Segment ending position |
|---|---|---|
| T46984_PEA_1_T2 | 3433 | 3437 |
| T46984_PEA_1_T3 (SEQ ID NO: 315) | 2827 | 2831 |
| T46984_PEA_1_T12 (SEQ ID NO: 316) | 2227 | 2231 |
| T46984_PEA_1_T13 (SEQ ID NO: 317) | 2258 | 2262 |
| T46984_PEA_1_T15 (SEQ ID NO: 319) | 2116 | 2120 |
| T46984_PEA_1_T19 (SEQ ID NO: 320) | 4061 | 4065 |
| T46984_PEA_1_T23 (SEQ ID NO: 321) | 3337 | 3341 |
| T46984_PEA_1_T27 (SEQ ID NO: 322) | 2017 | 2021 |
| T46984_PEA_1_T32 (SEQ ID NO: 323) | 2023 | 2027 |
| T46984_PEA_1_T34 (SEQ ID NO: 324) | 1769 | 1773 |
| T46984_PEA_1_T35 (SEQ ID NO: 325) | 1927 | 1931 |
| T46984_PEA_1_T43 (SEQ ID NO: 328) | 1205 | 1209 |
| T46984_PEA_1_T46 (SEQ ID NO: 329) | 1519 | 1523 |
| T46984_PEA_1_T47 (SEQ ID NO: 330) | 958 | 962 |
| T46984_PEA_1_T51 (SEQ ID NO: 332) | 555 | 559 |
| T46984_PEA_1_T52 (SEQ ID NO: 333) | 1058 | 1062 |
| T46984_PEA_1_T54 (SEQ ID NO: 334) | 1058 | 1062 |

Segment cluster T46984_PEA_1_node_84 (SEQ ID NO: 382) according to the present invention can be found in the following transcript(s): T46984_PEA_1_T2, T46984_PEA_1_T3 (SEQ ID NO: 315), T46984_PEA_1_T12 (SEQ ID NO: 316), T46984_PEA_1_T13 (SEQ ID NO: 317), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T43 (SEQ ID NO: 328), T46984_PEA_1_T46 (SEQ ID NO: 329), T46984_PEA_1_T47 (SEQ ID NO: 330), T46984_PEA_1_T51 (SEQ ID NO: 332), T46984_PEA_1_T52 (SEQ ID NO: 333) and T46984_PEA_1_T54 (SEQ ID NO: 334). Table 95 below describes the starting and ending position of this segment on each transcript.

TABLE 95

Segment location on transcripts

| Transcript name | Segment starting position | Segment ending position |
|---|---|---|
| T46984_PEA_1_T2 | 3438 | 3451 |
| T46984_PEA_1_T3 (SEQ ID NO: 315) | 2832 | 2845 |
| T46984_PEA_1_T12 (SEQ ID NO: 316) | 2232 | 2245 |
| T46984_PEA_1_T13 (SEQ ID NO: 317) | 2263 | 2276 |
| T46984_PEA_1_T15 (SEQ ID NO: 319) | 2121 | 2134 |
| T46984_PEA_1_T19 (SEQ ID NO: 320) | 4066 | 4079 |
| T46984_PEA_1_T23 (SEQ ID NO: 321) | 3342 | 3355 |
| T46984_PEA_1_T27 (SEQ ID NO: 322) | 2022 | 2035 |
| T46984_PEA_1_T32 (SEQ ID NO: 323) | 2028 | 2041 |
| T46984_PEA_1_T34 (SEQ ID NO: 324) | 1774 | 1787 |
| T46984_PEA_1_T35 (SEQ ID NO: 325) | 1932 | 1945 |
| T46984_PEA_1_T43 (SEQ ID NO: 328) | 1210 | 1223 |
| T46984_PEA_1_T46 (SEQ ID NO: 329) | 1524 | 1537 |
| T46984_PEA_1_T47 (SEQ ID NO: 330) | 963 | 976 |
| T46984_PEA_1_T51 (SEQ ID NO: 332) | 560 | 573 |
| T46984_PEA_1_T52 (SEQ ID NO: 333) | 1063 | 1076 |
| T46984_PEA_1_T54 (SEQ ID NO: 334) | 1063 | 1076 |

Segment cluster T46984_PEA_1_node_85 (SEQ ID NO: 383) according to the present invention is supported by 295 libraries. The number of libraries was determined as previously described. This segment can be found in the following transcript(s): T46984_PEA_1_T2, T46984_PEA_1_T3 (SEQ ID NO: 315), T46984_PEA_1_T12 (SEQ ID NO: 316), T46984_PEA_1_T13 (SEQ ID NO: 317), T46984_PEA_1_T15 (SEQ ID NO: 319), T46984_PEA_1_T19 (SEQ ID NO: 320), T46984_PEA_1_T23 (SEQ ID NO: 321), T46984_PEA_1_T27 (SEQ ID NO: 322), T46984_PEA_1_T32 (SEQ ID NO: 323), T46984_PEA_1_T34 (SEQ ID NO: 324), T46984_PEA_1_T35 (SEQ ID NO: 325), T46984_PEA_1_T43 (SEQ ID NO: 328), T46984_PEA_1_T46 (SEQ ID NO: 329), T46984_PEA_1_T47 (SEQ ID NO: 330), T46984_PEA_1_T51 (SEQ ID NO: 332), T46984_PEA_1_T52 (SEQ ID NO: 333) and T46984_PEA_1_T54 (SEQ ID NO: 334). Table 96 below describes the starting and ending position of this segment on each transcript.

TABLE 96

Segment location on transcripts

| Transcript name | Segment starting position | Segment ending position |
|---|---|---|
| T46984_PEA_1_T2 | 3452 | 3491 |
| T46984_PEA_1_T3 (SEQ ID NO: 315) | 2846 | 2885 |
| T46984_PEA_1_T12 (SEQ ID NO: 316) | 2246 | 2285 |
| T46984_PEA_1_T13 (SEQ ID NO: 317) | 2277 | 2316 |
| T46984_PEA_1_T15 (SEQ ID NO: 319) | 2135 | 2174 |
| T46984_PEA_1_T19 (SEQ ID NO: 320) | 4080 | 4119 |
| T46984_PEA_1_T23 (SEQ ID NO: 321) | 3356 | 3395 |
| T46984_PEA_1_T27 (SEQ ID NO: 322) | 2036 | 2075 |

TABLE 96-continued

Segment location on transcripts

| Transcript name | Segment starting position | Segment ending position |
|---|---|---|
| T46984_PEA_1_T32 (SEQ ID NO: 323) | 2042 | 2081 |
| T46984_PEA_1_T34 (SEQ ID NO: 324) | 1788 | 1827 |
| T46984_PEA_1_T35 (SEQ ID NO: 325) | 1946 | 1985 |
| T46984_PEA_1_T43 (SEQ ID NO: 328) | 1224 | 1263 |
| T46984_PEA_1_T46 (SEQ ID NO: 329) | 1538 | 1577 |
| T46984_PEA_1_T47 (SEQ ID NO: 330) | 977 | 1016 |
| T46984_PEA_1_T51 (SEQ ID NO: 332) | 574 | 613 |
| T46984_PEA_1_T52 (SEQ ID NO: 333) | 1077 | 1116 |
| T46984_PEA_1_T54 (SEQ ID NO: 334) | 1077 | 1116 |

Escore: 0

Matching length: 498 Total length: 498

Matching Percent Similarity: 100.00 Matching Percent

Identity: 100.00

Total Percent Similarity: 100.00 Total Percent

Identity: 100.00

Gaps: 0

Alignment:

```
  1 MAPPGSSTVFLLALTIIASTWALTPTHYLTKHDVERLKASLDRPFTNLES  50
    ||||||||||||||||||||||||||||||||||||||||||||||||||
  1 MAPPGSSTVFLLALTIIASTWALTPTHYLTKHDVERLKASLDRPFTNLES  50

51 AFYSIVGLSSLGAQVPDAKKACTYIRSNLDPSNVDSLFYAAQASQALSGC 100
    ||||||||||||||||||||||||||||||||||||||||||||||||||
 51 AFYSIVGLSSLGAQVPDAKKACTYIRSNLDPSNVDSLFYAAQASQALSGC 100

101 EISISNETKDLLLAAVSEDSSVTQIYHAVAALSGFGLPLASQEALSALTA 150
    ||||||||||||||||||||||||||||||||||||||||||||||||||
101 EISISNETKDLLLAAVSEDSSVTQIYHAVAALSGFGLPLASQEALSALTA 150

151 RLSKEETVLATVQALQTASHLSQQADLRSIVEEIEDLVARLDELGGVYLQ 200
    ||||||||||||||||||||||||||||||||||||||||||||||||||
151 RLSKEETVLATVQALQTASHLSQQADLRSIVEEIEDLVARLDELGGVYLQ 200

201 REEGLETTALFVAATYKLMDHVGTEPSIKEDQVIQLMNAIFSKKNFESLS 250
    ||||||||||||||||||||||||||||||||||||||||||||||||||
201 REEGLETTALFVAATYKLMDHVGTEPSIKEDQVIQLMNAIFSKKNFESLS 250

251 EAFSVASAAAVLSHNRYHVPVVVVPEGSASDTHEQAILRLQVTNVLSQPL 300
    ||||||||||||||||||||||||||||||||||||||||||||||||||
251 EAFSVASAAAVLSHNRYHVPVVVVPEGSASDTHEQAILRLQVTNVLSQPL 300

301 TQATVKLEHAKSVASRATVLQKTSFTPVGDVFELNFMNVKFSSGYYDFLV 350
    ||||||||||||||||||||||||||||||||||||||||||||||||||
301 TQATVKLEHAKSVASRATVLQKTSFTPVGDVFELNFMNVKFSSGYYDELV 350

351 EVEGDNRYIANTVELRVKISTEVGITNVDLSTVDKDQSIAPKTTRVTYPA 400
    ||||||||||||||||||||||||||||||||||||||||||||||||||
351 EVEGDNRYIANTVELRVKISTEVGITNVDLSTVDKDQSIAPKTTRVTYPA 400

401 KAKGTFIADSHQNFALFFQLVDVNTGAELTPHQTFVRLHNQKTGQEVVFV 450
    ||||||||||||||||||||||||||||||||||||||||||||||||||
401 KAKGTFIADSHQNFALFFQLVDVNTGAELTPHQTFVRLHNQKTGQEVVFV 450

451 AEPDNKNVYKFELDTSERKIEFDSASGTYTLYLIIGDATLKNPILWNV   498
    ||||||||||||||||||||||||||||||||||||||||||||||||
451 AEPDNKNVYKFELDTSERKIEFDSASGTYTLYLIIGDATLKNPILWNV   498
```

Variant protein alignment to the previously known protein:

Sequence name: RIB2_HUMAN

Sequence documentation:

Alignment of: T46984_PEA_1_P2 x RIB2_HUMAN . . .

Alignment segment 1/1:
 Quality: 4716.00

Sequence name: RIB2_HUMAN

Sequence documentation:

Alignment of: T46984_PEA_1_P3 x RIB2_HUMAN . . .

Alignment segment 1/1:
 Quality: 4085.00

Escore: 0

Matching length: 433 Total length: 433

Matching Percent Similarity: 100.00 Matching Percent

Identity: 100.00
    Total Percent Similarity: 100.00 Total Percent

Identity: 100.00
    Gaps: 0

Alignment:

```
  1 MAPPGSSTVFLLALTIIASTWALTPTHYLTKHDVERLKASLDRPFTNLES  50
    ||||||||||||||||||||||||||||||||||||||||||||||||||
  1 MAPPGSSTVFLLALTIIASTWALTPTHYLTKHDVERLKASLDRPFTNLES  50

51 AFYSIVGLSSLGAQVPDAKKACTYIRSNLDPSNVDSLFYAAQASQALSGC 100
    ||||||||||||||||||||||||||||||||||||||||||||||||||
 51 AFYSIVGLSSLGAQVPDAKKACTYIRSNLDPSNVDSLFYAAQASQALSGC 100

101 EISISNETKDLLLAAVSEDSSVTQIYHAVAALSGFGLPLASQEALSALTA 150
    ||||||||||||||||||||||||||||||||||||||||||||||||||
101 EISISNETKDLLLAAVSEDSSVTQIYHAVAALSGFGLPLASQEALSALTA 150

151 RLSKEETVLATVQALQTASHLSQQADLRSIVEEIEDLVARLDELGGVYLQ 200
    ||||||||||||||||||||||||||||||||||||||||||||||||||
151 RLSKEETVLATVQALQTASHLSQQADLRSIVEEIEDLVARLDELGGVYLQ 200

201 REEGLETTALFVAATYKLMDHVGTEPSIKEDQVIQLMNAIFSKKNFESLS 250
    ||||||||||||||||||||||||||||||||||||||||||||||||||
201 REEGLETTALFVAATYKLMDHVGTEPSIKEDQVIQLMNAIFSKKNFESLS 250

251 EAFSVASAAAVLSHNRYHVPVVVVPEGSASDTHEQAILRLQVTNVLSQPL 300
    ||||||||||||||||||||||||||||||||||||||||||||||||||
251 EAFSVASAAAVLSHNRYHVPVVVVPEGSASDTHEQAILRLQVTNVLSQPL 300

301 TQATVKLEHAKSVASRATVLQKTSFTPVGDVFELNFMNVKFSSGYYDFLV 350
    ||||||||||||||||||||||||||||||||||||||||||||||||||
301 TQATVKLEHAKSVASRATVLQKTSFTPVGDVFELNFMNVKFSSGYYDELV 350

351 EVEGDNRYIANTVELRVKISTEVGITNVDLSTVDKDQSIAPKTTRVTYPA 400
    ||||||||||||||||||||||||||||||||||||||||||||||||||
351 EVEGDNRYIANTVELRVKISTEVGITNVDLSTVDKDQSIAPKTTRVTYPA 400

401 KAKGTFIADSHQNFALFFQLVDVNTGAELTPHQ                 433
    |||||||||||||||||||||||||||||||||
401 KAKGTFIADSHQNFALFFQLVDVNTGAELTPHQ                 433
```

Sequence name: RIB2_HUMAN

Sequence documentation:

Alignment of: T46984_PEA__1_P10 (SEQ ID NO: 387) x RIB2_HUMAN . . .

Alignment segment 1/1:
    Quality: 4716.00

Escore: 0
    Matching length: 498 Total length: 498

Matching Percent Similarity: 100.00 Matching Percent

Identity: 100.00
    Total Percent Similarity: 100.00 Total Percent

Identity: 100.00
    Gaps: 0

Alignment:

```
  1 MAPPGSSTVFLLALTIIASTWALTPTHYLTKHDVERLKASLDRPFTNLES  50
    ||||||||||||||||||||||||||||||||||||||||||||||||||
  1 MAPPGSSTVFLLALTIIASTWALTPTHYLTKHDVERLKASLDRPFTNLES  50

51 AFYSIVGLSSLGAQVPDAKKACTYIRSNLDPSNVDSLFYAAQASQALSGC 100
    ||||||||||||||||||||||||||||||||||||||||||||||||||
 51 AFYSIVGLSSLGAQVPDAKKACTYIRSNLDPSNVDSLFYAAQASQALSGC 100

101 EISISNETKDLLLAAVSEDSSVTQIYHAVAALSGFGLPLASQEALSALTA 150
    ||||||||||||||||||||||||||||||||||||||||||||||||||
101 EISISNETKDLLLAAVSEDSSVTQIYHAVAALSGFGLPLASQEALSALTA 150

151 RLSKEETVLATVQALQTASHLSQQADLRSIVEEIEDLVARLDELGGVYLQ 200
    ||||||||||||||||||||||||||||||||||||||||||||||||||
151 RLSKEETVLATVQALQTASHLSQQADLRSIVEEIEDLVARLDELGGVYLQ 200

201 REEGLETTALFVAATYKLMDHVGTEPSIKEDQVIQLMNAIFSKKNFESLS 250
    ||||||||||||||||||||||||||||||||||||||||||||||||||
201 REEGLETTALFVAATYKLMDHVGTEPSIKEDQVIQLMNAIFSKKNFESLS 250

251 EAFSVASAAAVLSHNRYHVPVVVVPEGSASDTHEQAILRLQVTNVLSQPL 300
    ||||||||||||||||||||||||||||||||||||||||||||||||||
251 EAFSVASAAAVLSHNRYHVPVVVVPEGSASDTHEQAILRLQVTNVLSQPL 300

301 TQATVKLEHAKSVASRATVLQKTSFTPVGDVFELNFMNVKFSSGYYDFLV 350
    ||||||||||||||||||||||||||||||||||||||||||||||||||
301 TQATVKLEHAKSVASRATVLQKTSFTPVGDVFELNFMNVKFSSGYYDELV 350

351 EVEGDNRYIANTVELRVKISTEVGITNVDLSTVDKDQSIAPKTTRVTYPA 400
    ||||||||||||||||||||||||||||||||||||||||||||||||||
351 EVEGDNRYIANTVELRVKISTEVGITNVDLSTVDKDQSIAPKTTRVTYPA 400

401 KAKGTFIADSHQNFALFFQLVDVNTGAELTPHQTFVRLHNQKTGQEVVFV 450
    ||||||||||||||||||||||||||||||||||||||||||||||||||
401 KAKGTFIADSHQNFALFFQLVDVNTGAELTPHQTFVRLHNQKTGQEVVFV 450

451 AEPDNKNVYKFELDTSERKIEFDSASGTYTLYLIIGDATLKNPILWNV   498
    |||||||||||||||||||||||||||||||||||||||||||||||
451 AEPDNKNVYKFELDTSERKIEFDSASGTYTLYLIIGDATLKNPILWNV   498
```

Sequence name: RIB2_HUMAN

Sequence documentation:

Alignment of: T46984_PEA_1_P11 (SEQ ID NO: 388) x RIB2_HUMAN . . .

Alignment segment 1/1:
　Quality: 5974.00

Escore: 0
　Matching length: 628 Total length: 628

Matching Percent Similarity: 100.00 Matching Percent

Identity: 100.00
　Total Percent Similarity: 100.00 Total Percent

Identity: 100.00
　Gaps: 0

Alignment:

```
  1 MAPPGSSTVFLLALTIIASTWALTPTHYLTKHDVERLKASLDRPFTNLES  50
    ||||||||||||||||||||||||||||||||||||||||||||||||||
  1 MAPPGSSTVFLLALTIIASTWALTPTHYLTKHDVERLKASLDRPFTNLES  50

51 AFYSIVGLSSLGAQVPDAKKACTYIRSNLDPSNVDSLFYAAQASQALSGC 100
    ||||||||||||||||||||||||||||||||||||||||||||||||||
 51 AFYSIVGLSSLGAQVPDAKKACTYIRSNLDPSNVDSLFYAAQASQALSGC 100

101 EISISNETKDLLLAAVSEDSSVTQIYHAVAALSGFGLPLASQEALSALTA 150
    ||||||||||||||||||||||||||||||||||||||||||||||||||
101 EISISNETKDLLLAAVSEDSSVTQIYHAVAALSGFGLPLASQEALSALTA 150

151 RLSKEETVLATVQALQTASHLSQQADLRSIVEEIEDLVARLDELGGVYLQ 200
    ||||||||||||||||||||||||||||||||||||||||||||||||||
151 RLSKEETVLATVQALQTASHLSQQADLRSIVEEIEDLVARLDELGGVYLQ 200

201 REEGLETTALFVAATYKLMDHVGTEPSIKEDQVIQLMNAIFSKKNFESLS 250
    ||||||||||||||||||||||||||||||||||||||||||||||||||
201 REEGLETTALFVAATYKLMDHVGTEPSIKEDQVIQLMNAIFSKKNFESLS 250

251 EAFSVASAAAVLSHNRYHVPVVVVPEGSASDTHEQAILRLQVTNVLSQPL 300
    ||||||||||||||||||||||||||||||||||||||||||||||||||
251 EAFSVASAAAVLSHNRYHVPVVVVPEGSASDTHEQAILRLQVTNVLSQPL 300

301 TQATVKLEHAKSVASRATVLQKTSFTPVGDVFELNFMNVKFSSGYYDFLV 350
    |||||||||||||||||||||||||||||||||||||||||||||||:||
301 TQATVKLEHAKSVASRATVLQKTSFTPVGDVFELNFMNVKFSSGYYDELV 350

351 EVEGDNRYIANTVELRVKISTEVGITNVDLSTVDKDQSIAPKTTRVTYPA 400
    ||||||||||||||||||||||||||||||||||||||||||||||||||
351 EVEGDNRYIANTVELRVKISTEVGITNVDLSTVDKDQSIAPKTTRVTYPA 400

401 KAKGTFIADSHQNFALFFQLVDVNTGAELTPHQTFVRLHNQKTGQEVVFV 450
    ||||||||||||||||||||||||||||||||||||||||||||||||||
401 KAKGTFIADSHQNFALFFQLVDVNTGAELTPHQTFVRLHNQKTGQEVVFV 450

451 AEPDNKNVYKFELDTSERKIEFDSASGTYTLYLIIGDATLKNPILWNVAD 498
    ||||||||||||||||||||||||||||||||||||||||||||||||||
451 AEPDNKNVYKFELDTSERKIEFDSASGTYTLYLIIGDATLKNPILWNVAD 498

501 VVIKFPEEEAPSTVLSQNLFTPKQEIQHLFREPEKRPPTVVSNTFTALIL 550
    ||||||||||||||||||||||||||||||||||||||||||||||||||
501 VVIKFPEEEAPSTVLSQNLFTPKQEIQHLFREPEKRPPTVVSNTFTALIL 550

551 SPLLLLFALWIRIGANVSNFTFAPSTIIFHLGHAAMLGLMYVYWTQLNMF 600
    ||||||||||||||||||||||||||||||||||||||||||||||||||
551 SPLLLLFALWIRIGANVSNFTFAPSTIIFHLGHAAMLGLMYVYWTQLNMF 600

601 QTLKYLAILGSVTFLAGNRMLAQQAVKR                      628
    ||||||||||||||||||||||||||||
601 QTLKYLAILGSVTFLAGNRMLAQQAVKR                      628
```

Sequence name: RIB2_HUMAN

Sequence documentation:

Alignment of: T46984_PEA_1_P12 (SEQ ID NO: 389) x RIB2_HUMAN . . .

Alignment segment 1/1:
 Quality: 3179.00

Escore: 0
 Matching length: 338 Total length: 338

Matching Percent Similarity: 100.00 Matching Percent Identity: 100.00
 Total Percent Similarity: 100.00 Total Percent Identity: 100.00
 Gaps: 0

Alignment:

```
  1 MAPPGSSTVFLLALTIIASTWALTPTHYLTKHDVERLKASLDRPFTNLES  50
    ||||||||||||||||||||||||||||||||||||||||||||||||||
  1 MAPPGSSTVFLLALTIIASTWALTPTHYLTKHDVERLKASLDRPFTNLES  50

51 AFYSIVGLSSLGAQVPDAKKACTYIRSNLDPSNVDSLFYAAQASQALSGC 100
    ||||||||||||||||||||||||||||||||||||||||||||||||||
 51 AFYSIVGLSSLGAQVPDAKKACTYIRSNLDPSNVDSLFYAAQASQALSGC 100

101 EISISNETKDLLLAAVSEDSSVTQIYHAVAALSGFGLPLASQEALSALTA 150
    ||||||||||||||||||||||||||||||||||||||||||||||||||
101 EISISNETKDLLLAAVSEDSSVTQIYHAVAALSGFGLPLASQEALSALTA 150
```

-continued

```
151 RLSKEETVLATVQALQTASHLSQQADLRSIVEEIEDLVARLDELGGVYLQ 200
    ||||||||||||||||||||||||||||||||||||||||||||||||||
151 RLSKEETVLATVQALQTASHLSQQADLRSIVEEIEDLVARLDELGGVYLQ 200

201 FEEGLETTALFVAATYKLMDHVGTEPSIKEDQVIQLMNAIFSKKNFESLS 250
    ||||||||||||||||||||||||||||||||||||||||||||||||||
201 FEEGLETTALFVAATYKLMDHVGTEPSIKEDQVIQLMNAIFSKKNFESLS 250

251 EAFSVASAAAVLSHNRYHVPVVVVPEGSASDTHEQAILRLQVTNVLSQPL 300
    ||||||||||||||||||||||||||||||||||||||||||||||||||
251 EAFSVASAAAVLSHNRYHVPVVVVPEGSASDTHEQAILRLQVTNVLSQPL 300

301 TQATVKLEHAKSVASRATVLQKTSFTPVGDVFELNFMN 338
    |||||||||||||||||||||||||||||||||||||
301 TQATVKLEHAKSVASRATVLQKTSFTPVGDVFELNFMN 338
```

Sequence name: RIB2_HUMAN

Sequence documentation:

Alignment of: T46984_PEA_1_P21 (SEQ ID NO. 390 x RIB2_HUMAN . . .

Alignment segment 1/1:
  Quality: 5348.00

Escore: 0
  Matching length: 562 Total length: 562

Matching Percent Similarity: 100.00 Matching Percent Identity: 100.00

Total Percent Similarity: 100.00 Total Percent Identity: 100.00

Gaps: 0

Alignment:

```
  2 KACTYIRSNLDPSNVDSLFYAAQASQALSGCEISISNETKDLLLAAVSED  51
    ||||||||||||||||||||||||||||||||||||||||||||||||||
 70 KACTYIRSNLDPSNVDSLFYAAQASQALSGCEISISNETKDLLLAAVSED 119

52 SSVTQIYHAVAALSGFGLPLASQEALSALTARLSKEETVLATVQALQTAS 101
    ||||||||||||||||||||||||||||||||||||||||||||||||||
120 SSVTQIYHAVAALSGFGLPLASQEALSALTARLSKEETVLATVQALQTAS 169

102 HLSQQADLRSIVEEIEDLVARLDELGGVYLQFEEGLETTALFVAATYKLM 151
    ||||||||||||||||||||||||||||||||||||||||||||||||||
170 HLSQQADLRSIVEEIEDLVARLDELGGVYLQFEEGLETTALFVAATYKLM 219

152 DHVGTEPSIKEDQVIQLMNAIFSKKNFESLSEAFSVASAAAVLSHNRYHV 201
    ||||||||||||||||||||||||||||||||||||||||||||||||||
220 DHVGTEPSIKEDQVIQLMNAIFSKKNFESLSEAFSVASAAAVLSHNRYHV 269

202 PVVVVPEGSASDTHEQAILRLQVTNVLSQPLTQATVKLEHAKSVASRATV 251
    ||||||||||||||||||||||||||||||||||||||||||||||||||
270 PVVVVPEGSASDTHEQAILRLQVTNVLSQPLTQATVKLEHAKSVASRATV 319

252 LQKTSFTPVGDVFELNFMNVKFSSGYYDFLVEVEGDNRYIANTVELRVKI 301
    ||||||||||||||||||||||||||||||||||||||||||||||||||
320 LQKTSFTPVGDVFELNFMNVKFSSGYYDFLVEVEGDNRYIANTVELRVKI 369

302 STEVGITNVDLSTVDKDQSIAPKTTRVTYPAKAKGTFIADSHQNFALFFQ 351
    ||||||||||||||||||||||||||||||||||||||||||||||||||
370 STEVGITNVDLSTVDKDQSIAPKTTRVTYPAKAKGTFIADSHQNFALFFQ 419

352 LVDVNTGAELTPHQTFVRLHNQKTGQEVVFVAEPDNKNVYKFELDTSERK 401
    ||||||||||||||||||||||||||||||||||||||||||||||||||
420 LVDVNTGAELTPHQTFVRLHNQKTGQEVVFVAEPDNKNVYFFELDTSERK 469

402 IEFDSASGTYTLYLIIGDATLKNPILWNVADVVIKFPEEEAPSTVLSQNL 451
    ||||||||||||||||||||||||||||||||||||||||||||||||||
470 IEFDSASGTYTLYLIIGDATLKNPILWNVADVVIKFPEEEAPSTVLSQNL 519

452 FTPKQEIQHLFREPEKRPPTVVSNTFTALILSPLLLLFALWIRIGANVSN 501
    ||||||||||||||||||||||||||||||||||||||||||||||||||
520 FTPKQEIQHLFREPEKRPPTVVSNTFTALILSPLLLLFALWIRIGANVSN 569

502 FTFAPSTIIFHLGHAAMLGLMYVYWTQLNMFQTLKYLAILGSVTFLAGNR 551
    ||||||||||||||||||||||||||||||||||||||||||||||||||
570 FTFAPSTIIFHLGHAAMLGLMYVYWTQLNMFQTLKYLAILGSVTFLAGNR 619
```

```
552  MLAQQAVKRTAH        563
     ||||||||||||
620  MLAQQAVKRTAH        631
```

Sequence name: RIB2_HUMAN

Sequence documentation:

Alignment of: T46984_PEA__1_P27 (SEQ ID NO: 391) x RIB2_HUMAN . . .

Alignment segment 1/1:
　Quality: 3910.00

Escore: 0
　Matching length: 415 Total length: 415

Matching Percent Similarity: 100.00 Matching Percent Identity: 100.00
　Total Percent Similarity: 100.00 Total Percent Identity: 100.00
　Gaps: 0

Alignment:

Sequence name: RIB2_HUMAN

Sequence documentation:

Alignment of: T46984_PEA__1_P32 (SEQ ID NO: 392) x RIB2_HUMAN . . .

Alignment segment 1/1:
　Quality: 3434.00

Escore: 0
　Matching length: 373 Total length: 373

Matching Percent Similarity: 98.93 Matching Percent Identity: 98.39
　Total Percent Similarity: 98.93 Total Percent Identity: 98.39
　Gaps: 0

```
  1  MAPPGSSTVFLLALTIIASTWALTPTHYLTKHDVERLKASLDRPFTNLES     50
     ||||||||||||||||||||||||||||||||||||||||||||||||||
  1  MAPPGSSTVFLLALTIIASTWALTPTHYLTKHDVERLKASLDRPFTNLES     50

51  AFYSIVGLSSLGAQVPDAKKACTYIRSNLDPSNVDSLFYAAQASQALSGC    100
     ||||||||||||||||||||||||||||||||||||||||||||||||||
 51  AFYSIVGLSSLGAQVPDAKKACTYIRSNLDPSNVDSLFYAAQASQALSGC    100

101  EISISNETKDLLLAAVSEDSSVTQIYHAVAALSGFGLPLASQEALSALTA    150
     ||||||||||||||||||||||||||||||||||||||||||||||||||
101  EISISNETKDLLLAAVSEDSSVTQIYHAVAALSGFGLPLASQEALSALTA    150

151  RLSKEETVLATVQALQTASHLSQQADLRSIVEEIEDLVARLDELGGVYLQ    200
     ||||||||||||||||||||||||||||||||||||||||||||||||||
151  RLSKEETVLATVQALQTASHLSQQADLRSIVEEIEDLVARLDELGGVYLQ    200

201  FEEGLETTALFVAATYKLMDHVGTEPSIKEDQVIQLMNAIFSKKNFESLS    250
     ||||||||||||||||||||||||||||||||||||||||||||||||||
201  FEEGLETTALFVAATYKLMDHVGTEPSIKEDQVIQLMNAIFSKKNFESLS    250

251  EAFSVASAAAVLSHNRYHVPVVVVPEGSASDTHEQAILRLQVTNVLSQPL    300
     ||||||||||||||||||||||||||||||||||||||||||||||||||
251  EAFSVASAAAVLSHNRYHVPVVVVPEGSASDTHEQAILRLQVTNVLSQPL    300

301  TQATVKLEHAKSVASRATVLQKTSFTPVGDVFELNFMNVKFSSGYYDFLV    350
     ||||||||||||||||||||||||||||||||||||||||||||||||||
301  TQATVKLEHAKSVASRATVLQKTSFTPVGDVFELNFMNVKFSSGYYDFLV    350

351  EVEGDNRYIANTVELRVKISTEVGITNVDLSTVDKDQSIAPKTTRVTYPA    400
     ||||||||||||||||||||||||||||||||||||||||||||||||||
351  EVEGDNRYIANTVELRVKISTEVGITNVDLSTVDKDQSIAPKTTRVTYPA    400

401  KAKGTFIADSHQNFA    415
     |||||||||||||||
401  KAKGTFIADSHQNFA    415
```

Alignment:

```
  1 MAPPGSSTVFLLALTIIASTWALTPTHYLTKHDVERLKASLDRPFTNLES   50
    ||||||||||||||||||||||||||||||||||||||||||||||||||
  1 MAPPGSSTVFLLALTIIASTWALTPTHYLTKHDVERLKASLDRPFTNLES   50

51 AFYSIVGLSSLGAQVPDAKKACTYIRSNLDPSNVDSLFYAAQASQALSGC  100
    ||||||||||||||||||||||||||||||||||||||||||||||||||
 51 AFYSIVGLSSLGAQVPDAKKACTYIRSNLDPSNVDSLFYAAQASQALSGC  100

101 EISISNETKDLLLAAVSEDSSVTQIYHAVAALSGFGLPLASQEALSALTA  150
    ||||||||||||||||||||||||||||||||||||||||||||||||||
101 EISISNETKDLLLAAVSEDSSVTQIYHAVAALSGFGLPLASQEALSALTA  150

151 RLSKEETVLATVQALQTASHLSQQADLRSIVEEIEDLVARLDELGGVYLQ  200
    ||||||||||||||||||||||||||||||||||||||||||||||||||
151 RLSKEETVLATVQALQTASHLSQQADLRSIVEEIEDLVARLDELGGVYLQ  200

201 FEEGLETTALFVAATYKLMDHVGTEPSIKEDQVIQLMNAIFSKKNFESLS  250
    ||||||||||||||||||||||||||||||||||||||||||||||||||
201 FEEGLETTALFVAATYKLMDHVGTEPSIKEDQVIQLMNAIFSKKNFESLS  250

251 EAFSVASAAAVLSHNRYHVPVVVVPEGSASDTHEQAILRLQVTNVLSQPL  300
    ||||||||||||||||||||||||||||||||||||||||||||||||||
251 EAFSVASAAAVLSHNRYHVPVVVVPEGSASDTHEQAILRLQVTNVLSQPL  300

301 TQATVKLEHAKSVASRATVLQKTSFTPVGDVFELNFMNVKFSSGYYDFLV  350
    ||||||||||||||||||||||||||||||||||||||||||||||||||
301 TQATVKLEHAKSVASRATVLQKTSFTPVGDVFELNFMNVKFSSGYYDFLV  350

351 EVEGDNRYIANTVEGQVRWLTPV                             373
    |||||||||||||||: |:  | |
351 EVEGDNRYIANTVELRVKISTEV                             373
```

Sequence name: RIB2_HUMAN

Sequence documentation:

Alignment of: T46984_PEA_1_P34 (SEQ ID NO: 393) x RIB2_HUMAN ...

Alignment segment 1/1:
 Quality: 3087.00

Escore: 0

Matching length: 329 Total length: 329

Matching Percent Similarity: 100.00 Matching Percent Identity: 100.00

Total Percent Similarity: 100.00 Total Percent Identity: 100.00

Gaps: 0

Alignment:

```
  1 MAPPGSSTVFLLALTIIASTWALTPTHYLTKHDVERLKASLDRPFTNLES   50
    ||||||||||||||||||||||||||||||||||||||||||||||||||
  1 MAPPGSSTVFLLALTIIASTWALTPTHYLTKHDVERLKASLDRPFTNLES   50

51 AFYSIVGLSSLGAQVPDAKKACTYIRSNLDPSNVDSLFYAAQASQALSGC  100
    ||||||||||||||||||||||||||||||||||||||||||||||||||
 51 AFYSIVGLSSLGAQVPDAKKACTYIRSNLDPSNVDSLFYAAQASQALSGC  100

101 EISISNETKDLLLAAVSEDSSVTQIYHAVAALSGFGLPLASQEALSALTA  150
    ||||||||||||||||||||||||||||||||||||||||||||||||||
101 EISISNETKDLLLAAVSEDSSVTQIYHAVAALSGFGLPLASQEALSALTA  150

151 RLSKEETVLATVQALQTASHLSQQADLRSIVEEIEDLVARLDELGGVYLQ  200
    ||||||||||||||||||||||||||||||||||||||||||||||||||
151 RLSKEETVLATVQALQTASHLSQQADLRSIVEEIEDLVARLDELGGVYLQ  200

201 FEEGLETTALFVAATYKLMDHVGTEPSIKEDQVIQLMNAIFSKKNFESLS  250
    ||||||||||||||||||||||||||||||||||||||||||||||||||
201 FEEGLETTALFVAATYKLMDHVGTEPSIKEDQVIQLMNAIFSKKNFESLS  250

251 EAFSVASAAAVLSHNRYHVPVVVVPEGSASDTHEQAILRLQVTNVLSQPL  300
    ||||||||||||||||||||||||||||||||||||||||||||||||||
251 EAFSVASAAAVLSHNRYHVPVVVVPEGSASDTHEQAILRLQVTNVLSQPL  300

301 TQATVKLEHAKSVASRATVLQKTSFTPVG                       329
    |||||||||||||||||||||||||||||
301 TQATVKLEHAKSVASRATVLQKTSFTPVG                       329
```

Sequence name: RIB2_HUMAN

Sequence documentation:

Alignment of: T46984_PEA_1_P35 (SEQ ID NO: 394) x RIB2_HUMAN ...

Alignment segment 1/1:
  Quality: 2697.00
Escore: 0
  Matching length: 287 Total
length: 287
Matching Percent Similarity: 100.00 Matching Percent
Identity: 100.00
  Total Percent Similarity: 100.00 Total Percent
Identity: 100.00
  Gaps: 0
Alignment:

```
  1  MAPPGSSTVFLLALTIIASTWALTPTHYLTKHDVERLKASLDRPFTNLES    50
     |||||||||||||||||||||||||||||||||||||||||||||||||
  1  MAPPGSSTVFLLALTIIASTWALTPTHYLTKHDVERLKASLDRPFTNLES    50

51  AFYSIVGLSSLGAQVPDAKKACTYIRSNLDPSNVDSLFYAAQASQALSGC   100
     |||||||||||||||||||||||||||||||||||||||||||||||||
 51  AFYSIVGLSSLGAQVPDAKKACTYIRSNLDPSNVDSLFYAAQASQALSGC   100

101  EISISNETKDLLLAAVSEDSSVTQIYHAVAALSGFGLPLASQEALSALTA   150
     |||||||||||||||||||||||||||||||||||||||||||||||||
101  EISISNETKDLLLAAVSEDSSVTQIYHAVAALSGFGLPLASQEALSALTA   150

151  RLSKEETVLATVQALQTASHLSQQADLRSIVEEIEDLVARLDELGGVYLQ   200
     |||||||||||||||||||||||||||||||||||||||||||||||||
151  RLSKEETVLATVQALQTASHLSQQADLRSIVEEIEDLVARLDELGGVYLQ   200

201  FEEGLETTALFVAATYKLMDHVGTEPSIKEDQVIQLMNAIFSKKNFESLS   250
     |||||||||||||||||||||||||||||||||||||||||||||||||
201  FEEGLETTALFVAATYKLMDHVGTEPSIKEDQVIQLMNAIFSKKNFESLS   250

251  EAFSVASAAAVLSHNRYHVPVVVVPEGSASDTHEQAI                287
     |||||||||||||||||||||||||||||||||||||
251  EAFSVASAAAVLSHNRYHVPVVVVPEGSASDTHEQAI                287
```

Sequence name: RIB2_HUMAN

Sequence documentation:

Alignment of: T46984_PEA_1_P38 (SEQ ID NO: 395) x RIB2_HUMAN ...

Alignment segment 1/1:
  Quality: 1368.00

Escore: 0

Matching length: 145 Total length: 145

Matching Percent Similarity: 100.00 Matching Percent

Identity: 100.00

Total Percent Similarity: 100.00 Total Percent

Identity: 100.00

Gaps: 0

Alignment:

```
  1  MAPPGSSTVFLLALTIIASTWALTPTHYLTKHDVERLKASLDRPFTNLES    50
     |||||||||||||||||||||||||||||||||||||||||||||||||
  1  MAPPGSSTVFLLALTIIASTWALTPTHYLTKHDVERLKASLDRPFTNLES    50

51  AFYSIVGLSSLGAQVPDAKKACTYIRSNLDPSNVDSLFYAAQASQALSGC   100
     |||||||||||||||||||||||||||||||||||||||||||||||||
 51  AFYSIVGLSSLGAQVPDAKKACTYIRSNLDPSNVDSLFYAAQASQALSGC   100

101  EISISNETKDLLLAAVSEDSSVTQIYHAVAALSGFGLPLASQEAL        145
     ||||||||||||||||||||||||||||||||||||||||||||
101  EISISNETKDLLLAAVSEDSSVTQIYHAVAALSGFGLPLASQEAL        145
```

Sequence name: RIB2_HUMAN

Sequence documentation:

Alignment of: T46984_PEA_1_P39 (SEQ ID NO: 396) x RIB2_HUMAN ...

Alignment segment 1/1:
  Quality: 1500.00

Escore: 0
  Matching length: 160 Total length: 160

Matching Percent Similarity: 100.00 Matching Percent

Identity: 100.00
  Total Percent Similarity: 100.00 Total Percent

Identity: 100.00
  Gaps: 0

Alignment:

```
  1  MAPPGSSTVFLLALTIIASTWALTPTHYLTKHDVERLKASLDRPFTNLES   50
     ||||||||||||||||||||||||||||||||||||||||||||||||||
  1  MAPPGSSTVFLLALTIIASTWALTPTHYLTKHDVERLKASLDRPFTNLES   50

51  AFYSIVGLSSLGAQVPDAKKACTYIRSNLDPSNVDSLFYAAQASQALSGC  100
     ||||||||||||||||||||||||||||||||||||||||||||||||||
 51  AFYSIVGLSSLGAQVPDAKKACTYIRSNLDPSNVDSLFYAAQASQALSGC  100

101  EISISNETKDLLLAAVSEDSSVTQIYHAVAALSGFGLPLASQEALSALTA  150
     ||||||||||||||||||||||||||||||||||||||||||||||||||
101  EISISNETKDLLLAAVSEDSSVTQIYHAVAALSGFGLPLASQEALSALTA  150

151  RLSKEETVLA                                          160
     ||||||||||
151  RLSKEETVLA                                          160
```

Sequence name: RIB2_HUMAN

Sequence documentation:

Alignment of: T46984_PEA_1_P45 (SEQ ID NO: 397) x RIB2_HUMAN . . .

Alignment segment 1/1:
  Quality: 970.00

Escore: 0
  Matching length: 103 Total length: 103

Matching Percent Similarity: 99.03 Matching Percent

Identity: 99.03
  Total Percent Similarity: 99.03 Total Percent

Identity: 99.03
  Gaps: 0

Alignment:

```
  1  MAPPGSSTVFLLALTIIASTWALTPTHYLTKHDVERLKASLDRPFTNLES   50
     ||||||||||||||||||||||||||||||||||||||||||||||||||
  1  MAPPGSSTVFLLALTIIASTWALTPTHYLTKHDVERLKASLDRPFTNLES   50

51  AFYSIVGLSSLGAQVPDAKKACTYIRSNLDPSNVDSLFYAAQASQALSGC  100
     ||||||||||||||||||||||||||||||||||||||||||||||||||
 51  AFYSIVGLSSLGAQVPDAKKACTYIRSNLDPSNVDSLFYAAQASQALSGC  100

101  ENS                                                 103
     |||
101  ENS                                                 103
```

Sequence name: RIB2_HUMAN

Sequence documentation:

Alignment of: T46984_PEA_1_P46 (SEQ ID NO: 398) x RIB2_HUMAN ...

Alignment segment 1/1:
  Quality: 656.00

Escore: 0
  Matching length: 69 Total length: 69

Matching Percent Similarity: 100.00 Matching Percent Identity: 100.00
  Total Percent Similarity: 100.00 Total Percent Identity: 100.00
  Gaps: 0

Alignment:

```
 1  MAPPGSSTVFLLALTIIASTWALTPTHYLTKHDVERLKASLDRPFTNLES  50
    |||||||||||||||||||||||||||||||||||||||||||||||||
 1  MAPPGSSTVFLLALTIIASTWALTPTHYLTKHDVERLKASLDRPFTNLES  50

51  AFYSIVGLSSLGAQVPDAK                                69
    |||||||||||||||||||
51  AFYSIVGLSSLGAQVPDAK                                69
```

DESCRIPTION FOR CLUSTER M78530

Cluster M78530 features 3 transcript(s) and 21 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| M78530_PEA_1_T11 | 399 |
| M78530_PEA_1_T12 | 400 |
| M78530_PEA_1_T13 | 401 |

TABLE 2

Segments of interest

| Segment Name | SEQ ID NO: |
|---|---|
| M78530_PEA_1_node_0 | 402 |
| M78530_PEA_1_node_15 | 403 |
| M78530_PEA_1_node_16 | 404 |
| M78530_PEA_1_node_19 | 405 |
| M78530_PEA_1_node_21 | 406 |
| M78530_PEA_1_node_23 | 407 |
| M78530_PEA_1_node_27 | 408 |
| M78530_PEA_1_node_29 | 409 |
| M78530_PEA_1_node_36 | 410 |
| M78530_PEA_1_node_37 | 411 |
| M78530_PEA_1_node_2 | 412 |
| M78530_PEA_1_node_4 | 413 |
| M78530_PEA_1_node_5 | 414 |
| M78530_PEA_1_node_7 | 415 |
| M78530_PEA_1_node_9 | 416 |
| M78530_PEA_1_node_10 | 417 |
| M78530_PEA_1_node_18 | 418 |
| M78530_PEA_1_node_25 | 419 |
| M78530_PEA_1_node_30 | 420 |
| M78530_PEA_1_node_33 | 421 |
| M78530_PEA_1_node_34 | 422 |

TABLE 3

Proteins of interest

| Protein Name | SEQ ID NO: | Corresponding Transcript(s) |
|---|---|---|
| M78530_PEA_1_P15 | 426 | M78530_PEA_1_T11 (SEQ ID NO:399) |
| M78530_PEA_1_P16 | 427 | M78530_PEA_1_T12 (SEQ ID NO.400) |
| M78530_PEA_1_P17 | 428 | M78530_PEA_1_T13 (SEQ ID NO:401) |

Cluster M78530 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 40 refer to weighted expression of ESTs in each category, as "parts per million" (ratio of the expression of ESTs for a particular cluster to the expression of all ESTs in that category, according to parts per million).

Figure 40:
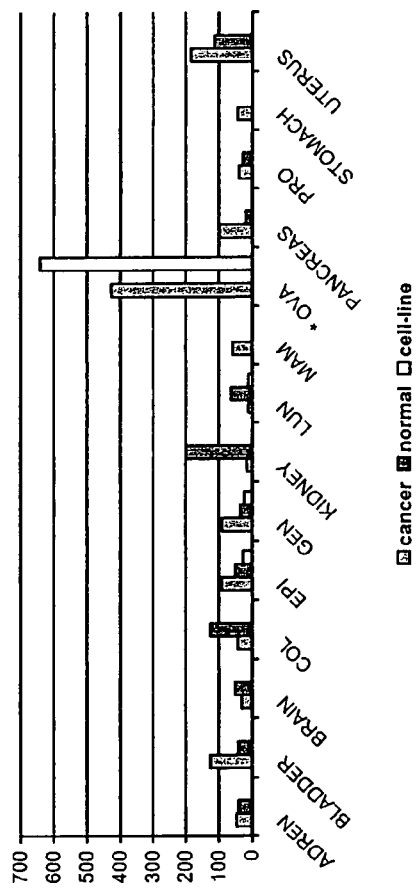
FIG. 40 shows cancer and cell-line vs. normal tissue expression.

Overall, the following results were obtained as shown with regard to the histograms in FIG. 40 and Table 4. This cluster is overexpressed (at least at a minimum level) in the following pathological conditions: ovarian carcinoma.

TABLE 4

Normal tissue distribution

| Name of Tissue | Number |
|---|---|
| adrenal | 40 |
| bladder | 41 |
| brain | 52 |
| colon | 126 |

TABLE 4-continued

Normal tissue distribution

| Name of Tissue | Number |
| --- | --- |
| epithelial | 51 |
| general | 35 |
| kidney | 199 |
| lung | 63 |
| breast | 0 |
| ovary | 0 |
| pancreas | 20 |
| prostate | 28 |
| stomach | 0 |
| uterus | 113 |

TABLE 5

P values and ratios for expression in cancerous tissue

| Name of Tissue | P1 | P2 | SP1 | R3 | SP2 | R4 |
| --- | --- | --- | --- | --- | --- | --- |
| adrenal | 6.4e−01 | 6.9e−01 | 7.1e−01 | 1.1 | 7.8e−01 | 0.9 |
| bladder | 3.3e−01 | 4.5e−01 | 2.8e−01 | 2.0 | 4.9e−01 | 1.4 |
| brain | 7.9e−01 | 8.1e−01 | 8.5e−01 | 0.6 | 9.8e−01 | 0.4 |
| colon | 4.7e−01 | 6.1e−01 | 9.7e−01 | 0.5 | 9.9e−01 | 0.4 |
| epithelial | 2.0e−01 | 8.2e−01 | 3.3e−03 | 1.6 | 2.5e−01 | 0.9 |
| general | 1.3e−01 | 8.5e−01 | 7.4e−10 | 2.2 | 6.0e−04 | 1.4 |
| kidney | 7.0e−01 | 7.6e−01 | 1 | 0.2 | 1 | 0.1 |
| lung | 8.6e−01 | 9.1e−01 | 1 | 0.3 | 1 | 0.3 |
| breast | 1.9e−01 | 2.8e−01 | 3.3e−01 | 2.4 | 5.6e−01 | 1.6 |
| ovary | 1.6e−02 | 1.3e−02 | 7.0e−05 | 10.3 | 6.3e−06 | 9.3 |
| pancreas | 2.6e−01 | 4.1e−01 | 3.5e−02 | 2.2 | 1.2e−01 | 1.5 |
| prostate | 7.9e−01 | 8.6e−01 | 4.7e−01 | 1.2 | 6.3e−01 | 1.0 |
| stomach | 1.1e−01 | 4.5e−01 | 5.0e−01 | 2.2 | 8.0e−01 | 1.3 |
| uterus | 5.3e−01 | 8.2e−01 | 2.4e−01 | 1.0 | 7.7e−01 | 0.6 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below (in relation to ovarian cancer), shown in Table 6.

TABLE 6

Oligonucleotides related to this cluster

| Oligonucleotide name | Overexpressed in cancers | Chip reference |
| --- | --- | --- |
| M78530_0_6_0 (SEQ ID NO:1027) | ovarian carcinoma | OVA |

As noted above, cluster M78530 features 3 transcript(s), which were listed in Table 1 above. A description of each variant protein according to the present invention is now provided.

Variant protein M78530_PEA_1_P15 (SEQ ID NO: 426) according to the present invention has an amino acid sequence as given at the end of the application; it is encoded by transcript(s) M78530_PEA_1_T11 (SEQ ID NO: 399). One or more alignments to one or more previously published protein sequences are given at the end of the application. A brief description of the relationship of the variant protein according to the present invention to each such aligned protein is as follows:

Comparison report between M78530_PEA_1_P15 (SEQ ID NO: 426) and Q9HCB6 (SEQ ID NO:424):

1. An isolated chimeric polypeptide encoding for M78530_PEA_1_P15 (SEQ ID NO: 426), comprising a first amino acid sequence being at least 90% homologous to MRLSPAPLKLSRTPALLALALP-LAAALAFSDETLDKVPKSEGYCSRIL-RAQGTRREGYT EFSLRVEGDPDFYKPGTSYRVTL-SAAPPSYFRGFTLIALRENREGDKEEDHAGTFQIIDEE ETQFMSNCPVAVTESTPRRRTRIQVF-WIAPPAGTGCVILKASIVQKRIIYFQDEGSLTKKL CEQDSTFDGVTDKPILDCCACGTAKYR-LTFYGNWSEKTHPKDYPRRANHWSAIIGGSH SKNYVLWEYGGYASEGVKQVAELGSPVK-MEEEIRQQSDEVLTVIKAKAQWPAWQPLN VRAAP-SAEFSVDRTRHLMSFLTMMGPSPDWN-VGLSAEDLCTKECGWVQKVVQDLIPW DAGTDSGVTYESPNKPTIPQEKIR-PLTSLDHPQSPFYDPEGGSITQVARVVIERIARKGEQ CNIVPDNVDDIVADLAPEEKDEDDTPE-TCIYSNWSPWSACSSSTCDKGKRMRQRMLKA QLDLSVPCPDTQDFQPCMGPGCSDEDG-STCTMSEWITWSPCSISCGMGMRSRERYVKQ FPEDGSVCTLPTEE corresponding to amino acids 1-544 of Q9HCB6, which also corresponds to amino acids 1-544 of M78530_PEA_1_P15 (SEQ ID NO: 426), a bridging amino acid T corresponding to amino acid 545 of M78530_PEA_1_P15 (SEQ ID NO: 426), a second amino acid sequence being at least 90% homologous to EKCTVNEECSPSS-CLMTEWGEWDECSATCGMGMKKRHRMIK-MNPADGSMCKAETSQ AEKCMMPECHTIPCLLSP-WSEWSDCSVTCGKGMRTRQRMLKSLAELGDCNED LEQVE KCMLPEC corresponding to amino acids 546-665 of Q9HCB6, which also corresponds to amino acids 546-665 of M78530_PEA_1_P15 (SEQ ID NO: 426), and a third amino acid sequence being at least 70%, optionally at least 80%, preferably at least 85%, more preferably at least 90% and most preferably at least 95% homologous to a polypeptide having the sequence RKSWSSSRPITSMFLSPGSPEP-ASANTARS (SEQ ID NO: 1070) corresponding to amino acids 666-695 of M78530_PEA_1_P15 (SEQ ID NO: 426), wherein said first amino acid sequence, bridging amino acid, second amino acid sequence and third amino acid sequence are contiguous and in a sequential order.

2. An isolated polypeptide encoding for a tail of M78530_PEA_1_P15 (SEQ ID NO: 426), comprising a polypeptide being at least 70%, optionally at least about 80%, preferably at least about 85%, more preferably at least about 90% and most preferably at least about 95% homologous to the sequence RKSWSSSRPITSMFLSPGSPEPASANTARS (SEQ ID NO: 1070) in M78530_PEA_1_P15 (SEQ ID NO: 426).

Comparison report between M78530_PEA_1_P15 (SEQ ID NO: 426) and O94862 (SEQ ID NO:425):

1. An isolated chimeric polypeptide encoding for M78530_PEA_1_P15 (SEQ ID NO: 426), comprising a first amino acid sequence being at least 70%, optionally at least 80%, preferably at least 85%, more preferably at least 90% and most preferably at least 95% homologous to a polypeptide having the sequence MRLSPAPLKLSRTPALLALALP-LAAALAFSDETLDKVPKSEGYCSRIL-RAQGTRREGYT EFSLRVEGDPDFYKPGTSYRVTLS (SEQ ID NO: 1071) corresponding to amino acids 1-83 of M78530_PEA_1_P15 (SEQ ID NO: 426), a second amino acid sequence being at least 90% homologous to AAPPSY-FRGFTLIALRENREGDKEEDHAGTFQI-IDEEETQFMSNCPVAVTESTPRRRTRIQ VFWIAPPAGT- GCVILKASIVQKRIIYFQDEGSLTKKLCEQDSTFDGV
TDKPILDCCACGT AKYRLTFYGNWSEKTHP-
KDYPRRANHWSAIIGGSHSKNYVLWEYG-
GYASEGVKQVAE LGSPVKMEEEIRQQSDEVLT-
VIKAKAQWPAWQPLNVRAAPSAEFSVDRTRHLMSF
LTM MGPSPDWNVGLSAEDLCTKECGWVQKV-
VQDLIPWDAGTDSGVTYESPNKPTIPQEKIR
PLTSLDHPQSPFYDPEGGSITQVARV-
VIERIARKGEQCNIVPDNVDDIVADLAPEEKDED
DTPETCIYSNWSPWSACSSSTCDKGKRM-
RQRMLKAQLDLSVPCPDTQDFQPCMGPGCS DEDG-
STCTMSEWITWSPCSISCGMGMRSR-
ERYVKQFPEDGSVCTLPTEETEKCTVNEEC
SPSSCLMTEWGEWDECSATCGMG-
MKKRHRMIKMNPADGSMCKAETSQAEKCMMPE
CHTIPCLLSPWSEWSDCSVTCGKGMR-
TRQRMLKSLAELGDCNEDLEQVEKCMLPEC corresponding to amino acids 1-582 of O94862, which also corresponds to amino acids 84-665 of M78530_PEA__1_P15 (SEQ ID NO: 426), and a third amino acid sequence being at least 70%, optionally at least 80%, preferably at least 85%, more preferably at least 90% and most preferably at least 95% homologous to a polypeptide having the sequence RKSWSSSRPITSMFLSPGSPEPASANTARS (SEQ ID NO: 1070) corresponding to amino acids 666-695 of M78530_PEA__1_P15 (SEQ ID NO: 426), wherein said first amino acid sequence, second amino acid sequence and third amino acid sequence are contiguous and in a sequential order.

2. An isolated polypeptide encoding for a head of M78530_PEA__1_P15 (SEQ ID NO: 426), comprising a polypeptide being at least 70%, optionally at least about 80%, preferably at least about 85%, more preferably at least about 90% and most preferably at least about 95% homologous to the sequence MRLSPAPLKLSRTPALLALALP-LAAALAFSDETLDKVPKSEGYCSRIL-
RAQGTRREGYT EFSLRVEGDPDFYKPGTSYRVTLS (SEQ ID NO: 1071) of M78530_PEA__1_P15 (SEQ ID NO: 426).

3. An isolated polypeptide encoding for a tail of M78530_PEA__1_P15 (SEQ ID NO: 426), comprising a polypeptide being at least 70%, optionally at least about 80%, preferably at least about 85%, more preferably at least about 90% and most preferably at least about 95% homologous to the sequence RKSWSSSRPITSMFLSPGSPEPASANTARS (SEQ ID NO: 1070) in M78530_PEA__1_P15 (SEQ ID NO: 426).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78530_PEA__1_P15 (SEQ ID NO: 426) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein M78530_PEA__1_P15 (SEQ ID NO: 426) sequence provides support for the deduced sequence of this variant protein according to the present invention).

TABLE 7

Amino acid mutations

| SNP position(s) on amino acid sequence | Alternative amino acid(s) | Previously known SNP? |
|---|---|---|
| 278 | E -> D | No |
| 278 | E -> V | No |

Variant protein M78530_PEA__1_P15 (SEQ ID NO: 426) is encoded by the following transcript(s): M78530_PEA__1_T11 (SEQ ID NO: 399), for which the sequence(s) is/are given at the end of the application. The coding portion of transcript M78530_PEA__1_T11 (SEQ ID NO: 399) is shown in bold; this coding portion starts at position 629 and ends at position 2713. The transcript also has the following SNPs as listed in Table 8 (given according to their position on the nucleotide sequence, with the alternative nucleic acid listed; the last column indicates whether the SNP is known or not; the presence of known SNPs in variant protein M78530_PEA__1_P15 (SEQ ID NO: 426) sequence provides support for the deduced sequence of this variant protein according to the present invention).

TABLE 8

Nucleic acid SNPs

| SNP position on nucleotide sequence | Alternative nucleic acid | Previously known SNP? |
|---|---|---|
| 760 | C -> T | No |
| 1461 | A -> T | No |
| 1462 | G -> T | No |
| 1492 | A -> G | No |

Variant protein M78530_PEA__1_P16 (SEQ ID NO: 427) according to the present invention has an amino acid sequence as given at the end of the application; it is encoded by transcript(s) M78530_PEA__1_T12 (SEQ ID NO. 400). One or more alignments to one or more previously published protein sequences are given at the end of the application. A brief description of the relationship of the variant protein according to the present invention to each such aligned protein is as follows:

Comparison report between M78530_PEA__1_P16 (SEQ ID NO: 427) and Q8NCD7 (SEQ ID NO: 423):

1. An isolated chimeric polypeptide encoding for M78530_PEA__1_P16 (SEQ ID NO: 427), comprising a first amino acid sequence being at least 90% homologous to MRLSPAPLKLSRTPALLALALP-
LAAALAFSDETLDKVPKSEGYCSRIL-
RAQGTRREGYT EFSLRVEGDPDFYKPGTSYRVTL-
SAAPPSYFRGFTLIALRENREGDKEEDHAGTFQIIDEE
ETQFMSNCPVAVTESTPRRRTRIQVF-
WIAPPAGTGCVILKASIVQKRIIYFQDEGSLTKKL
CEQDSTFDGVTDKPILDCCACGTAKYR-
LTFYGNWSEKTHPKDYPRRANHWSAIIGGSH
SKNYVLWEYGGYASEGVKQVAELGSPVK-
MEEEIRQQSDEVLTVIKAKAQWPAWQPLN V corresponding to amino acids 1-297 of Q8NCD7, which also corresponds to amino acids 1-297 of M78530_PEA__1_P16 (SEQ ID NO: 427).

Comparison report between M78530_PEA__1_P16 (SEQ ID NO: 427) and Q9HCB6 (SEQ ID NO: 424):

1. An isolated chimeric polypeptide encoding for M78530_PEA__1_P16 (SEQ ID NO: 427), comprising a first amino acid sequence being at least 90% homologous to MRLSPAPLKLSRTPALLALALP-
LAAALAFSDETLDKVPKSEGYCSRIL-
RAQGTRREGYT EFSLRVEGDPDFYKPGTSYRVTL-
SAAPPSYFRGFTLIALRENREGDKEEDHAGTFQIIDEE
ETQFMSNCPVAVTESTPRRRTRIQVF-
WIAPPAGTGCVILKASIVQKRIIYFQDEGSLTKKL
CEQDSTFDGVTDKPILDCCACGTAKYR-
LTFYGNWSEKTHPKDYPRRANHWSAIIGGSH
SKNYVLWEYGGYASEGVKQVAELGSPVK-
MEEEIRQQSDEVLTVIKAKAQWPAWQPLN V corresponding to amino acids 1-297 of Q9HCB6, which also corresponds to amino acids 1-297 of M78530_PEA_1_P16 (SEQ ID NO: 427).

Comparison report between M78530_PEA_1_P16 (SEQ ID NO: 427) and O94862 (SEQ ID NO: 425):

1. An isolated chimeric polypeptide encoding for M78530_PEA_1_P16 (SEQ ID NO: 427), comprising a first amino acid sequence being at least 70%, optionally at least 80%, preferably at least 85%, more preferably at least 90% and most preferably at least 95% homologous to a polypeptide having the sequence MRLSPAPLKLSRTPALLALALP-
LAAALAFSDETLDKVPKSEGYCSRIL-
RAQGTRREGYT EFSLRVEGDPDFYKPGTSYRVTLS (SEQ ID NO: 1071) corresponding to amino acids 1-83 of M78530_PEA_1_P16 (SEQ ID NO: 427), and a second amino acid sequence being at least 90% homologous to AAPPSYFRGFTLIALRENREGD-
KEEDHAGTFQIIDEEETQFM-
SNCPVAVTESTPRRRTRIQ VFWIAPPAGTGCVILKA-
SIVQKRIIYFQDEGSLTKKLCEQDSTFDGVTDKPILDC
CACGT AKYRLTFYGNWSEKTHPKDYPRRANHW-
SAIIGGSHSKNYVLWEYGGYASEGVKQVAE
LGSPVKMEEEIRQQSDEVLTVIKAKAQWPAWQPLNV corresponding to amino acids 1-214 of O94862, which also corresponds to amino acids 84-297 of M78530_PEA_1_P16 (SEQ ID NO: 427), wherein said first amino acid sequence and second amino acid sequence are contiguous and in a sequential order.

2. An isolated polypeptide encoding for a head of M78530_PEA_1_P16 (SEQ ID NO: 427), comprising a polypeptide being at least 70%, optionally at least about 80%, preferably at least about 85%, more preferably at least about 90% and most preferably at least about 95% homologous to the sequence MRLSPAPLKLSRTPALLALALP-
LAAALAFSDETLDKVPKSEGYCSRIL-
RAQGTRREGYT EFSLRVEGDPDFYKPGTSYRVTLS (SEQ ID NO: 1071) of M78530_PEA_1_P16 (SEQ ID NO: 427).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78530_PEA_1_P16 (SEQ ID NO: 427) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein M78530_PEA_1_P16 (SEQ ID NO: 427) sequence provides support for the deduced sequence of this variant protein according to the present invention).

TABLE 9

Amino acid mutations

| SNP position(s) on amino acid sequence | Alternative amino acid(s) | Previously known SNP? |
|---|---|---|
| 278 | E –> D | No |
| 278 | E –> V | No |

Variant protein M78530_PEA_1_P16 (SEQ ID NO: 427) is encoded by the following transcript(s): M78530_PEA_1_T12 (SEQ ID NO. 400), for which the sequence(s) is/are given at the end of the application. The coding portion of transcript M78530_PEA_1_T12 (SEQ ID NO. 400) is shown in bold; this coding portion starts at position 629 and ends at position 1519. The transcript also has the following SNPs as listed in Table 10 (given according to their position on the nucleotide sequence, with the alternative nucleic acid listed; the last column indicates whether the SNP is known or not; the presence of known SNPs in variant protein M78530_PEA_1_P16 (SEQ ID NO: 427) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 760 | C –> T | No |
| 1461 | A –> T | No |
| 1462 | G –> T | No |
| 1492 | A –> G | No |
| 1670 | T –> C | No |
| 1957 | T –> C | No |
| 2004 | A –> C | No |
| 2005 | A –> T | No |

Variant protein M78530_PEA_1_P17 (SEQ ID NO: 428) according to the present invention has an amino acid sequence as given at the end of the application; it is encoded by transcript(s) M78530_PEA_1_T13 (SEQ ID NO: 401). One or more alignments to one or more previously published protein sequences are given at the end of the application. A brief description of the relationship of the variant protein according to the present invention to each such aligned protein is as follows:

Comparison report between M78530_PEA_1_P17 (SEQ ID NO: 428) and Q8NCD7:

1. An isolated chimeric polypeptide encoding for M78530_PEA_1_P17 (SEQ ID NO: 428), comprising a first amino acid sequence being at least 90% homologous to MRLSPAPLKLSRTPALLALALP-
LAAALAFSDETLDKVPKSEGYCSRIL-
RAQGTRREGYT EFSLRVEGDPDFYKPGTSYRVTL-
SAAPPSYFRGFTLIALRENREGDKEEDHAGTFQIIDEE
ETQFMSNCPVAVTESTPRRRTRIQVF-
WIAPPAGTGCVILKASIVQKRIIYFQDEGSLTKKL
CEQDSTFDGVTDKPILDCCACGTAKYR-
LTFYGNWSEKTHPKDYPRRANHWSAIIGGSH
SKNYVLWEYGGYASEGVKQVAELGSPVK-
MEEEIRQQ corresponding to amino acids 1-275 of Q8NCD7, which also corresponds to amino acids 1-275 of M78530_PEA_1_P17 (SEQ ID NO: 428), and a second amino acid sequence being at least 70%, optionally at least 80%, preferably at least 85%, more preferably at least 90% and most preferably at least 95% homologous to a polypeptide having the sequence VRQKNHRMTK (SEQ ID NO: 1073) corresponding to amino acids 276-285 of M78530_PEA_1_P17 (SEQ ID NO: 428), wherein said first amino acid sequence and second amino acid sequence are contiguous and in a sequential order.

2. An isolated polypeptide encoding for a tail of M78530_PEA_1_P17 (SEQ ID NO: 428), comprising a polypeptide being at least 70%, optionally at least about 80%, preferably at least about 85%, more preferably at least about 90% and most preferably at least about 95% homologous to the sequence VRQKNHRMTK (SEQ ID NO: 1073) in M78530_PEA_1_P17 (SEQ ID NO: 428).

Comparison report between M78530_PEA_1_P17 (SEQ ID NO: 428) and Q9HCB6:

1. An isolated chimeric polypeptide encoding for M78530_PEA_1_P17 (SEQ ID NO: 428), comprising a first amino acid sequence being at least 90% homologous to MRLSPAPLKLSRTPALLALALP-
LAAALAFSDETLDKVPKSEGYCSRIL-
RAQGTRREGYT EFSLRVEGDPDFYKPGTSYRVTL-
SAAPPSYFRGFTLIALRENREGDKEEDHAGTFQIIDEE
ETQFMSNCPVAVTESTPRRRTRIQVF-
WIAPPAGTGCVILKASIVQKRIIYFQDEGSLTKKL
CEQDSTFDGVTDKPILDCCACGTAKYR-
LTFYGNWSEKTHPKDYPRRANHWSAIIGGSH
SKNYVLWEYGGYASEGVKQVAELGSPVK-
MEEEIRQQ corresponding to amino acids 1-275 of Q9HCB6, which also corresponds to amino acids 1-275 of M78530_PEA_1_P17 (SEQ ID NO: 428), and a second amino acid sequence being at least 70%, optionally at least 80%, preferably at least 85%, more preferably at least 90% and most preferably at least 95% homologous to a polypeptide having the sequence VRQKNHRMTK (SEQ ID NO: 1073) corresponding to amino acids 276-285 of M78530_PEA_1_P17 (SEQ ID NO: 428), wherein said first amino acid sequence and second amino acid sequence are contiguous and in a sequential order.

2. An isolated polypeptide encoding for a tail of M78530_PEA_1_P17 (SEQ ID NO: 428), comprising a polypeptide being at least 70%, optionally at least about 80%, preferably at least about 85%, more preferably at least about 90% and most preferably at least about 95% homologous to the sequence VRQKNHRMTK (SEQ ID NO: 1073) in M78530_PEA_1_P17 (SEQ ID NO: 428).

Comparison report between M78530_PEA_1_P17 (SEQ ID NO: 428) and O94862:

1. An isolated chimeric polypeptide encoding for M78530_PEA_1_P17 (SEQ ID NO: 428), comprising a first amino acid sequence being at least 70%, optionally at least 80%, preferably at least 85%, more preferably at least 90% and most preferably at least 95% homologous to a polypeptide having the sequence MRLSPAPLKLSRTPALLALALP-
LAAALAFSDETLDKVPKSEGYCSRIL-
RAQGTRREGYT EFSLRVEGDPDFYKPGTSYRVTLS (SEQ ID NO: 1071) corresponding to amino acids 1-83 of M78530_PEA_1_P17 (SEQ ID NO: 428), a second amino acid sequence being at least 90% homologous to AAPPSY-
FRGFTLIALRENREGDKEEDHAGTFQI-
IDEEETQFMSNCPVAVTESTPRRRTRIQ VFWIAPPAGT-
GCVILKASIVQKRIIYFQDEGSLTKKLCEQDSTFDGV
TDKPILDCCACGT AKYRLTFYGNWSEKTHP-
KDYPRRANHWSAIIGGSHSKNYVLWEYG-
GYASEGVKQVAE LGSPVKMEEEIRQQ corresponding to amino acids 1-192 of O94862, which also corresponds to amino acids 84-275 of M78530_PEA_1_P17 (SEQ ID NO: 428), and a third amino acid sequence being at least 70%, optionally at least 80%, preferably at least 85%, more preferably at least 90% and most preferably at least 95% homologous to a polypeptide having the sequence VRQKNHRMTK (SEQ ID NO: 1073) corresponding to amino acids 276-285 of M78530_PEA_1_P17 (SEQ ID NO: 428), wherein said first amino acid sequence, second amino acid sequence and third amino acid sequence are contiguous and in a sequential order.

2. An isolated polypeptide encoding for a head of M78530_PEA_1_P17 (SEQ ID NO: 428), comprising a polypeptide being at least 70%, optionally at least about 80%, preferably at least about 85%, more preferably at least about 90% and most preferably at least about 95% homologous to the sequence MRLSPAPLKLSRTPALLALALP-
LAAALAFSDETLDKVPKSEGYCSRIL-
RAQGTRREGYT EFSLRVEGDPDFYKPGTSYRVTLS (SEQ ID NO: 1071) of M78530_PEA_1_P17 (SEQ ID NO: 428).

3. An isolated polypeptide encoding for a tail of M78530_PEA_1_P17 (SEQ ID NO: 428), comprising a polypeptide being at least 70%, optionally at least about 80%, preferably at least about 85%, more preferably at least about 90% and most preferably at least about 95% homologous to the sequence VRQKNHRMTK (SEQ ID NO: 1073) in M78530_PEA_1_P17 (SEQ ID NO: 428).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78530_PEA_1_P17 (SEQ ID NO: 428) is encoded by the following transcript(s): M78530_PEA_1_T13 (SEQ ID NO: 401), for which the sequence(s) is/are given at the end of the application. The coding portion of transcript M78530_PEA_1_T13 (SEQ ID NO: 401) is shown in bold; this coding portion starts at position 629 and ends at position 1483. The transcript also has the following SNPs as listed in Table 11 (given according to their position on the nucleotide sequence, with the alternative nucleic acid listed; the last column indicates whether the SNP is known or not; the presence of known SNPs in variant protein M78530_PEA_1_P17 (SEQ ID NO: 428) sequence provides support for the deduced sequence of this variant protein according to the present invention).

TABLE 11

| Nucleic acid SNPs | | |
|---|---|---|
| SNP position on nucleotide sequence | Alternative nucleic acid | Previously known SNP? |
| 760 | C -> T | No |

As noted above, cluster M78530 features 21 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster M78530_PEA_1_node_0 (SEQ ID NO: 402) according to the present invention is supported by 21 libraries. The number of libraries was determined as previously described. This segment can be found in the following transcript(s): M78530_PEA_1_T11 (SEQ ID NO: 399), M78530_PEA_1_T12 (SEQ ID NO. 400) and M78530_PEA_1_T13 (SEQ ID NO: 401). Table 12 below describes the starting and ending position of this segment on each transcript.

TABLE 12

Segment location on transcripts

| Transcript name | Segment starting position | Segment ending position |
|---|---|---|
| M78530_PEA_1_T11 (SEQ ID NO:399) | 1 | 866 |
| M78530_PEA_1_T12 (SEQ ID NO.400) | 1 | 866 |
| M78530_PEA_1_T13 (SEQ ID NO:401) | 1 | 866 |

Segment cluster M78530_PEA_1_node_15 (SEQ ID NO: 403) according to the present invention is supported by 27 libraries. The number of libraries was determined as previously described. This segment can be found in the following transcript(s): M78530_PEA_1_T11 (SEQ ID NO: 399), M78530_PEA_1_T12 (SEQ ID NO. 400) and M78530_PEA_1_T13 (SEQ ID NO: 401). Table 13 below describes the starting and ending position of this segment on each transcript.

TABLE 13

Segment location on transcripts

| Transcript name | Segment starting position | Segment ending position |
|---|---|---|
| M78530_PEA_1_T11 (SEQ ID NO:399) | 1305 | 1453 |
| M78530_PEA_1_T12 (SEQ ID NO.400) | 1305 | 1453 |
| M78530_PEA_1_T13 (SEQ ID NO:401) | 1305 | 1453 |

Segment cluster M78530_PEA_1_node_16 (SEQ ID NO: 404) according to the present invention is supported by 1 libraries. The number of libraries was determined as previously described. This segment can be found in the following transcript(s): M78530_PEA_1_T13 (SEQ ID NO: 401). Table 14 below describes the starting and ending position of this segment on each transcript.

TABLE 14

Segment location on transcripts

| Transcript name | Segment starting position | Segment ending position |
|---|---|---|
| M78530_PEA_1_T13 (SEQ ID NO:401) | 1454 | 1593 |

Segment cluster M78530_PEA_1_node_19 (SEQ ID NO: 405) according to the present invention is supported by 2 libraries. The number of libraries was determined as previously described. This segment can be found in the following transcript(s): M78530_PEA_1_T12 (SEQ ID NO. 400). Table 15 below describes the starting and ending position of this segment on each transcript.

TABLE 15

Segment location on transcripts

| Transcript name | Segment starting position | Segment ending position |
|---|---|---|
| M78530_PEA_1_T12 (SEQ ID NO.400) | 1519 | 2461 |

Segment cluster M78530_PEA_1_node_21 (SEQ ID NO: 406) according to the present invention is supported by 27 libraries. The number of libraries was determined as previously described. This segment can be found in the following transcript(s): M78530_PEA_1_T11 (SEQ ID NO: 399). Table 16 below describes the starting and ending position of this segment on each transcript.

TABLE 16

Segment location on transcripts

| Transcript name | Segment starting position | Segment ending position |
|---|---|---|
| M78530_PEA_1_T11 (SEQ ID NO:399) | 1519 | 1720 |

Segment cluster M78530_PEA_1_node_23 (SEQ ID NO: 407) according to the present invention is supported by 22 libraries. The number of libraries was determined as previously described. This segment can be found in the following transcript(s): M78530_PEA_1_T11 (SEQ ID NO: 399). Table 17 below describes the starting and ending position of this segment on each transcript.

TABLE 17

Segment location on transcripts

| Transcript name | Segment starting position | Segment ending position |
|---|---|---|
| M78530_PEA_1_T11 (SEQ ID NO:399) | 1721 | 1861 |

Segment cluster M78530_PEA_1_node_27 (SEQ ID NO: 408) according to the present invention is supported by 26 libraries. The number of libraries was determined as previously described. This segment can be found in the following transcript(s): M78530_PEA_1_T11 (SEQ ID NO: 399). Table 18 below describes the starting and ending position of this segment on each transcript.

TABLE 18

Segment location on transcripts

| Transcript name | Segment starting position | Segment ending position |
|---|---|---|
| M78530_PEA_1_T11 (SEQ ID NO:399) | 1938 | 2120 |

Segment cluster M78530_PEA_1_node_29 (SEQ ID NO: 409) according to the present invention is supported by 34 libraries. The number of libraries was determined as previously described. This segment can be found in the following transcript(s): M78530_PEA_1_T11 (SEQ ID NO: 399). Table 19 below describes the starting and ending position of this segment on each transcript.

TABLE 19

Segment location on transcripts

| Transcript name | Segment starting position | Segment ending position |
|---|---|---|
| M78530_PEA_1_T11 (SEQ ID NO:399) | 2121 | 2278 |

Segment cluster M78530_PEA_1_node_36 (SEQ ID NO: 410) according to the present invention is supported by 41 libraries. The number of libraries was determined as previously described. This segment can be found in the following transcript(s): M78530_PEA_1_T11 (SEQ ID NO: 399). Table 20 below describes the starting and ending position of this segment on each transcript.

TABLE 20

Segment location on transcripts

| Transcript name | Segment starting position | Segment ending position |
|---|---|---|
| M78530_PEA_1_T11 (SEQ ID NO:399) | 2460 | 2624 |

Segment cluster M78530_PEA_1_node_37 (SEQ ID NO: 411) according to the present invention is supported by 1 libraries. The number of libraries was determined as previously described. This segment can be found in the following transcript(s): M78530_PEA_1_T11 (SEQ ID NO: 399). Table 21 below describes the starting and ending position of this segment on each transcript.

TABLE 21

Segment location on transcripts

| Transcript name | Segment starting position | Segment ending position |
|---|---|---|
| M78530_PEA_1_T11 (SEQ ID NO:399) | 2625 | 2816 |

According to an optional embodiment of the present invention, short segments related to the above cluster are also provided. These segments are up to about 120 bp in length, and so are included in a separate description.

Segment cluster M78530_PEA_1_node_2 (SEQ ID NO: 412) according to the present invention is supported by 21 libraries. The number of libraries was determined as previously described. This segment can be found in the following transcript(s): M78530_PEA_1_T11 (SEQ ID NO: 399), M78530_PEA_1_T12 (SEQ ID NO. 400) and M78530_PEA_1_T13 (SEQ ID NO: 401). Table 22 below describes the starting and ending position of this segment on each transcript.

TABLE 22

Segment location on transcripts

| Transcript name | Segment starting position | Segment ending position |
|---|---|---|
| M78530_PEA_1_T11 (SEQ ID NO:399) | 867 | 973 |
| M78530_PEA_1_T12 (SEQ ID NO:400) | 867 | 973 |
| M78530_PEA_1_T13 (SEQ ID NO:401) | 867 | 973 |

Segment cluster M78530_PEA_1_node_4 (SEQ ID NO: 413) according to the present invention is supported by 19 libraries. The number of libraries was determined as previously described. This segment can be found in the following transcript(s): M78530_PEA_1_T11 (SEQ ID NO: 399), M78530_PEA_1_T12 (SEQ ID NO. 400) and M78530_PEA_1_T13 (SEQ ID NO: 401). Table 23 below describes the starting and ending position of this segment on each transcript.

TABLE 23

Segment location on transcripts

| Transcript name | Segment starting position | Segment ending position |
|---|---|---|
| M78530_PEA_1_T11 (SEQ ID NO:399) | 974 | 1025 |
| M78530_PEA_1_T12 (SEQ ID NO:400) | 974 | 1025 |
| M78530_PEA_1_T13 (SEQ ID NO:401) | 974 | 1025 |

Segment cluster M78530_PEA_1_node_5 (SEQ ID NO: 414) according to the present invention is supported by 21 libraries. The number of libraries was determined as previously described. This segment can be found in the following transcript(s): M78530_PEA_1_T11 (SEQ ID NO: 399), M78530_PEA_1_T12 (SEQ ID NO. 400) and M78530_PEA_1_T13 (SEQ ID NO: 401). Table 24 below describes the starting and ending position of this segment on each transcript.

TABLE 24

Segment location on transcripts

| Transcript name | Segment starting position | Segment ending position |
|---|---|---|
| M78530_PEA_1_T11 (SEQ ID NO:399) | 1026 | 1107 |
| M78530_PEA_1_T12 (SEQ ID NO:400) | 1026 | 1107 |
| M78530_PEA_1_T13 (SEQ ID NO:401) | 1026 | 1107 |

Segment cluster M78530_PEA_1_node_7 (SEQ ID NO: 415) according to the present invention is supported by 23 libraries. The number of libraries was determined as previously described. This segment can be found in the following transcript(s): M78530_PEA_1_T11 (SEQ ID NO: 399), M78530_PEA_1_T12 (SEQ ID NO. 400) and M78530_PEA_1_T13 (SEQ ID NO: 401). Table 25 below describes the starting and ending position of this segment on each transcript.

TABLE 25

Segment location on transcripts

| Transcript name | Segment starting position | Segment ending position |
|---|---|---|
| M78530_PEA_1_T11 (SEQ ID NO:399) | 1108 | 1181 |
| M78530_PEA_1_T12 (SEQ ID NO:400) | 1108 | 1181 |
| M78530_PEA_1_T13 (SEQ ID NO:401) | 1108 | 1181 |

Segment cluster M78530_PEA_1_node_9 (SEQ ID NO: 416) according to the present invention is supported by 24 libraries. The number of libraries was determined as previously described. This segment can be found in the following transcript(s): M78530_PEA_1_T11 (SEQ ID NO: 399), M78530_PEA_1_T12 (SEQ ID NO. 400) and M78530_PEA_1_T13 (SEQ ID NO: 401). Table 26 below describes the starting and ending position of this segment on each transcript.

TABLE 26

Segment location on transcripts

| Transcript name | Segment starting position | Segment ending position |
|---|---|---|
| M78530_PEA_1_T11 (SEQ ID NO:399) | 1182 | 1288 |
| M78530_PEA_1_T12 (SEQ ID NO:400) | 1182 | 1288 |
| M78530_PEA_1_T13 (SEQ ID NO:401) | 1182 | 1288 |

Segment cluster M78530_PEA_1_node_10 (SEQ ID NO: 417) according to the present invention can be found in the following transcript(s): M78530_PEA_1_T11 (SEQ ID NO: 399), M78530_PEA_1_T12 (SEQ ID NO. 400) and M78530_PEA_1_T13 (SEQ ID NO: 401). Table 27 below describes the starting and ending position of this segment on each transcript.

TABLE 27

Segment location on transcripts

| Transcript name | Segment starting position | Segment ending position |
|---|---|---|
| M78530_PEA_1_T11 (SEQ ID NO:399) | 1289 | 1304 |
| M78530_PEA_1_T12 (SEQ ID NO:400) | 1289 | 1304 |
| M78530_PEA_1_T13 (SEQ ID NO:401) | 1289 | 1304 |

Segment cluster M78530_PEA_1_node_18 (SEQ ID NO: 418) according to the present invention is supported by 27 libraries. The number of libraries was determined as previously described. This segment can be found in the following transcript(s): M78530_PEA_1_T11 (SEQ ID NO: 399) and M78530_PEA_1_T12 (SEQ ID NO. 400). Table 28 below describes the starting and ending position of this segment on each transcript.

TABLE 28

Segment location on transcripts

| Transcript name | Segment starting position | Segment ending position |
|---|---|---|
| M78530_PEA_1_T11 (SEQ ID NO:399) | 1454 | 1518 |
| M78530_PEA_1_T12 (SEQ ID NO:400) | 1454 | 1518 |

Segment cluster M78530_PEA_1_node_25 (SEQ ID NO: 419) according to the present invention is supported by 22 libraries. The number of libraries was determined as previously described. This segment can be found in the following transcript(s): M78530_PEA_1_T11 (SEQ ID NO: 399). Table 29 below describes the starting and ending position of this segment on each transcript.

TABLE 29

Segment location on transcripts

| Transcript name | Segment starting position | Segment ending position |
|---|---|---|
| M78530_PEA_1_T11 (SEQ ID NO:399) | 1862 | 1937 |

Segment cluster M78530_PEA_1_node_30 (SEQ ID NO: 420) according to the present invention can be found in the following transcript(s): M78530_PEA_1_T11 (SEQ ID NO: 399). Table 30 below describes the starting and ending position of this segment on each transcript.

TABLE 30

Segment location on transcripts

| Transcript name | Segment starting position | Segment ending position |
|---|---|---|
| M78530_PEA_1_T11 (SEQ ID NO:399) | 2279 | 2291 |

Segment cluster M78530_PEA_1_node_33 (SEQ ID NO: 421) according to the present invention is supported by 32 libraries. The number of libraries was determined as previously described. This segment can be found in the following transcript(s): M78530_PEA_1_T11 (SEQ ID NO: 399). Table 31 below describes the starting and ending position of this segment on each transcript.

TABLE 31

Segment location on transcripts

| Transcript name | Segment starting position | Segment ending position |
|---|---|---|
| M78530_PEA_1_T11 (SEQ ID NO:399) | 2292 | 2346 |

Segment cluster M78530_PEA_1_node_34 (SEQ ID NO: 422) according to the present invention is supported by 34 libraries. The number of libraries was determined as previously described. This segment can be found in the following transcript(s): M78530_PEA_1_T11 (SEQ ID NO: 399). Table 32 below describes the starting and ending position of this segment on each transcript.

TABLE 32

Segment location on transcripts

| Transcript name | Segment starting position | Segment ending position |
|---|---|---|
| M78530_PEA_1_T11 (SEQ ID NO:399) | 2347 | 2459 |

Variant protein alignment to the previously known protein:

Sequence name: Q9HCB6

Sequence documentation:

Alignment of: M78530_PEA_1_P15 (SEQ ID NO: 426) x Q9HCB6 . . .

Alignment segment 1/1:

Quality: 6706.00

Escore: 0

Matching length: 665 Total length: 665

Matching Percent Similarity: 99.85 Matching Percent Identity: 99.85

Total Percent Similarity: 99.85 Total Percent Identity: 99.85

Gaps: 0

Alignment:

```
  1 MRLSPAPLKLSRTPALLALALPLAAALAFSDETLDKVPKSEGYCSRILRA   50
    ||||||||||||||||||||||||||||||||||||||||||||||||||
  1 MRLSPAPLKLSRTPALLALALPLAAALAFSDETLDKVPKSEGYCSRILRA   50

51 QGTRREGYTEFSLRVEGDPDFYKPGTSYRVTLSAAPPSYFRGFTLIALRE  100
    ||||||||||||||||||||||||||||||||||||||||||||||||||
 51 QGTRREGYTEFSLRVEGDPDFYKPGTSYRVTLSAAPPSYFRGFTLIALRE  100

101 NREGDKEEDHAGTFQIIDEEETQFMSNCPVAVTESTPRRRTRIQVFWIAP  150
    ||||||||||||||||||||||||||||||||||||||||||||||||||
101 NREGDKEEDHAGTFQIIDEEETQFMSNCPVAVTESTPRRRTRIQVFWIAP  150

151 PAGTGCVILKASIVQKRIIYFQDEGSLTKKLCEQDSTFDGVTDKPILDCC  200
    ||||||||||||||||||||||||||||||||||||||||||||||||||
151 PAGTGCVILKASIVQKRIIYFQDEGSLTKKLCEQDSTFDGVTDKPILDCC  200

201 ACGTAKYRLTFYGNWSEKTHPKDYPRRANHWSAIIGGSHSKNYVLWEYGG  250
    ||||||||||||||||||||||||||||||||||||||||||||||||||
201 ACGTAKYRLTFYGNWSEKTHPKDYPRRANHWSAIIGGSHSKNYVLWEYGG  250

251 YASEGVKQVAELGSPVKMEEEIRQQSDEVLTVIKAKAQWPAWQPLNVRAA  300
    ||||||||||||||||||||||||||||||||||||||||||||||||||
251 YASEGVKQVAELGSPVKMEEEIRQQSDEVLTVIKAKAQWPAWQPLNVRAA  300

301 PSAEFSVDRTRHLMSFLTMMGPSPDWNVGLSAEDLCTKECGWVQKVVQDL  350
    ||||||||||||||||||||||||||||||||||||||||||||||||||
301 PSAEFSVDRTRHLMSFLTMMGPSPDWNVGLSAEDLCTKECGWVQKVVQDL  350

351 IPWDAGTDSGVTYESPNKPTIPQEKIRPLTSLDHPQSPFYDPEGGSITQV  400
    ||||||||||||||||||||||||||||||||||||||||||||||||||
351 IPWDAGTDSGVTYESPNKPTIPQEKIRPLTSLDHPQSPFYDPEGGSITQV  400

401 ARVVIERIARKGEQCNIVPDNVDDIVADLAPEEKDEDDTPETCIYSNWSP  450
    ||||||||||||||||||||||||||||||||||||||||||||||||||
401 ARVVIERIARKGEQCNIVPDNVDDIVADLAPEEKDEDDTPETCIYSNWSP  450

451 WSACSSSTCDKGKRMRQRMLKAQLDLSVPCPDTQDFQPCMGPGCSDEDGS  500
    ||||||||||||||||||||||||||||||||||||||||||||||||||
451 WSACSSSTCDKGKRMRQRMLKAQLDLSVPCPDTQDFQPCMGPGCSDEDGS  500

501 TCTMSEWITWSPCSISCGMGMRSRERYVKQFPEDGSVCTLPTEETEKCTV  550
    ||||||||||||||||||||||||||||||||||||||||||||||||||
501 TCTMSEWITWSPCSISCGMGMRSRERYVKQFPEDGSVCTLPTEETEKCTV  550

551 NEECSPSSCLMTEWGEWDECSATCGMGMKKRHRMIKMNPADGSMCKAETS  600
    ||||||||||||||||||||||||||||||||||||||||||||||||||
551 NEECSPSSCLMTEWGEWDECSATCGMGMKKRHRMIKMNPADGSMCKAETS  600

601 QAEKCMMPECHTIPCLLSPWSEWSDCSVTCGKGMRTRQRMLKSLAELGDC  650
    ||||||||||||||||||||||||||||||||||||||||||||||||||
601 QAEKCMMPECHTIPCLLSPWSEWSDCSVTCGKGMRTRQRMLKSLAELGDC  650
```

-continued

```
651 NEDLEQVEKCMLPEC          665
    |||||||||||||||
651 NEDLEQVEKCMLPEC          665
```

Sequence name: O94862

Sequence documentation:

Gaps: 0

Alignment:

```
 84 AAPPSYFRGFTLIALRENREGDKEEDHAGTFQIIDEEETQFMSNCPVAVT 133
    ||||||||||||||||||||||||||||||||||||||||||||||||||
  1 AAPPSYFRGFTLIALRENREGDKEEDHAGTFQIIDEEETQFMSNCPVAVT  50

134 ESTPRRRTRIQVFWIAPPAGTGCVILKASIVQKRIIYFQDEGSLTKKLCE 183
    ||||||||||||||||||||||||||||||||||||||||||||||||||
 51 ESTPRRRTRIQVFWIAPPAGTGCVILKASIVQKRIIYFQDEGSLTKKLCE 100

184 QDSTFDGVTDKPILDCCACGTAKYRLTFYGNWSEKTHPKDYPRRANHWSA 233
    ||||||||||||||||||||||||||||||||||||||||||||||||||
101 QDSTFDGVTDKPILDCCACGTAKYRLTFYGNWSEKTHPKDYPRRANHWSA 150

234 IIGGSHSKNYVLWEYGGYASEGVKQVAELGSPVKMEEEIRQQSDEVLTVI 283
    ||||||||||||||||||||||||||||||||||||||||||||||||||
151 IIGGSHSKNYVLWEYGGYASEGVKQVAELGSPVKMEEEIRQQSDEVLTVI 200

284 KAKAQWPAWQPLNVRAAPSAEFSVDRTRHLMSFLTMMGPSPDWNVGLSAE 333
    ||||||||||||||||||||||||||||||||||||||||||||||||||
201 KAKAQWPAWQPLNVRAAPSAEFSVDRTRHLMSFLTMMGPSPDWNVGLSAE 250

334 DLCTKECGWVQKVVQDLIPWDAGTDSGVTYESPNKPTIPQEKIRPLTSLD 383
    ||||||||||||||||||||||||||||||||||||||||||||||||||
251 DLCTKECGWVQKVVQDLIPWDAGTDSGVTYESPNKPTIPQEKIRPLTSLD 300

384 HPQSPFYDPEGGSITQVARVVIERIARKGEQCNIVPDNVDDIVADLAPEE 433
    ||||||||||||||||||||||||||||||||||||||||||||||||||
301 HPQSPFYDPEGGSITQVARVVIERIARKGEQCNIVPDNVDDIVADLAPEE 350

434 KDEDDTPETCIYSNWSPWSACSSSTCDKGKRMRQRMLKAQLDLSVPCPDT 483
    ||||||||||||||||||||||||||||||||||||||||||||||||||
351 KDEDDTPETCIYSNWSPWSACSSSTCDKGKRMRQRMLKAQLDLSVPCPDT 400

484 QDFQPCMGPGCSDEDGSTCTMSEWITWSPCSISCGMGMRSRERYVKQFPE 533
    ||||||||||||||||||||||||||||||||||||||||||||||||||
401 QDFQPCMGPGCSDEDGSTCTMSEWITWSPCSISCGMGMRSRERYVKQFPE 450

534 DGSVCTLPTEETEKCTVNEECSPSSCLMTEWGEWDECSATCGMGMKKRHR 583
    ||||||||||||||||||||||||||||||||||||||||||||||||||
451 DGSVCTLPTEETEKCTVNEECSPSSCLMTEWGEWDECSATCGMGMKKRHR 500

584 MIKMNPADGSMCKAETSQAEKCMMPECHTIPCLLSPWSEWSDCSVTCGKG 633
    ||||||||||||||||||||||||||||||||||||||||||||||||||
501 MIKMNPADGSMCKAETSQAEKCMMPECHTIPCLLSPWSEWSDCSVTCGKG 550

634 MRTRQRMLKSLAELGDCNEDLEQVEKCMLPEC                 665
    |||||||||||||||||||||||||||||||
551 MRTRQRMLKSLAELGDCNEDLEQVEKCMLPEC                 582
```

Alignment of: M78530_PEA_1_P15 (SEQ ID NO: 426) x O94862...

Alignment segment 1/1:
Quality: 5926.00

Escore: 0
Matching length: 582 Total length: 582

Matching Percent Similarity: 100.00 Matching Percent Identity: 100.00

Total Percent Similarity: 100.00 Total Percent Identity: 100.00

Sequence name: Q8NCD7

Sequence documentation:

Alignment of: M78530_PEA_1_P16 (SEQ ID NO: 427) x Q8NCD7...

Alignment segment 1/1:
Quality: 2926.00

Escore: 0
Matching length: 297 Total length: 297

Matching Percent Similarity: 100.00 Matching Percent Identity: 100.00

1005

Total Percent Similarity: 100.00 Total Percent Identity: 100.00

Gaps: 0

Alignment:

```
  1 MRLSPAPLKLSRTPALLALALPLAAALAFSDETLDKVPKSEGYCSRILRA  50
    |||||||||||||||||||||||||||||||||||||||||||||||||
  1 MRLSPAPLKLSRTPALLALALPLAAALAFSDETLDKVPKSEGYCSRILRA  50

51 QGTRREGYTEFSLRVEGDPDFYKPGTSYRVTLSAAPPSYFRGFTLIALRE 100
    |||||||||||||||||||||||||||||||||||||||||||||||||
 51 QGTRREGYTEFSLRVEGDPDFYKPGTSYRVTLSAAPPSYFRGFTLIALRE 100

101 NREGDKEEDHAGTFQIIDEEETQFMSNCPVAVTESTPRRRTRIQVFWIAP 150
    |||||||||||||||||||||||||||||||||||||||||||||||||
101 NREGDKEEDHAGTFQIIDEEETQFMSNCPVAVTESTPRRRTRIQVFWIAP 150

151 PAGTGCVILKASIVQKRIIYFQDEGSLTKKLCEQDSTFDGVTDKPILDCC 200
    |||||||||||||||||||||||||||||||||||||||||||||||||
151 PAGTGCVILKASIVQKRIIYFQDEGSLTKKLCEQDSTFDGVTDKPILDCC 200

201 ACGTAKYRLTFYGNWSEKTHPKDYPRRANHWSAIIGGSHSKNYVLWEYGG 250
    |||||||||||||||||||||||||||||||||||||||||||||||||
201 ACGTAKYRLTFYGNWSEKTHPKDYPRRANHWSAIIGGSHSKNYVLWEYGG 250

251 YASEGVKQVAELGSPVKMEEEIRQQSDEVLTVIKAKAQWPAWQPLNV    297
    ||||||||||||||||||||||||||||||||||||||||||||||
251 YASEGVKQVAELGSPVKMEEEIRQQSDEVLTVIKAKAQWPAWQPLNV    297
```

Sequence name: Q9HCB6

Sequence documentation:

Alignment of: M78530_PEA_1_P16 (SEQ ID NO: 427) x Q9HCB6 . . .

Alignment segment 1/1:

Quality: 2926.00

Escore: 0

Matching length: 297 Total length: 297

Matching Percent Similarity: 100.00 Matching Percent

1006

Identity: 100.00

Total Percent Similarity: 100.00 Total Percent Identity: 100.00

Gaps: 0

Alignment:

```
  1 MRLSPAPLKLSRTPALLALALPLAAALAFSDETLDKVPKSEGYCSRILRA  50
    |||||||||||||||||||||||||||||||||||||||||||||||||
  1 MRLSPAPLKLSRTPALLALALPLAAALAFSDETLDKVPKSEGYCSRILRA  50

51 QGTRREGYTEFSLRVEGDPDFYKPGTSYRVTLSAAPPSYFRGFTLIALRE 100
    |||||||||||||||||||||||||||||||||||||||||||||||||
 51 QGTRREGYTEFSLRVEGDPDFYKPGTSYRVTLSAAPPSYFRGFTLIALRE 100

101 NREGDKEEDHAGTFQIIDEEETQFMSNCPVAVTESTPRRRTRIQVFWIAP 150
    |||||||||||||||||||||||||||||||||||||||||||||||||
101 NREGDKEEDHAGTFQIIDEEETQFMSNCPVAVTESTPRRRTRIQVFWIAP 150

151 PAGTGCVILKASIVQKRIIYFQDEGSLTKKLCEQDSTFDGVTDKPILDCC 200
    |||||||||||||||||||||||||||||||||||||||||||||||||
151 PAGTGCVILKASIVQKRIIYFQDEGSLTKKLCEQDSTFDGVTDKPILDCC 200

201 ACGTAKYRLTFYGNWSEKTHPKDYPRRANHWSAIIGGSHSKNYVLWEYGG 250
    |||||||||||||||||||||||||||||||||||||||||||||||||
201 ACGTAKYRLTFYGNWSEKTHPKDYPRRANHWSAIIGGSHSKNYVLWEYGG 250

251 YASEGVKQVAELGSPVKMEEEIRQQSDEVLTVIKAKAQWPAWQPLNV    297
    ||||||||||||||||||||||||||||||||||||||||||||||
251 YASEGVKQVAELGSPVKMEEEIRQQSDEVLTVIKAKAQWPAWQPLNV    297
```

Sequence name: O94862

Sequence documentation:

Alignment of: M78530_PEA_1_P16 (SEQ ID NO: 427) x O94862 . . .

Alignment segment 1/1:

Quality: 2135.00

Escore: 0

Matching length: 214 Total length: 214

Matching Percent Similarity: 100.00 Matching Percent

1007

Identity: 100.00
　Total Percent Similarity: 100.00 Total Percent

Identity: 100.00
　Gaps: 0

Alignment:

```
 84  AAPPSYFRGFTLIALRENREGDKEEDHAGTFQIIDEEETQFMSNCPVAVT  133
     |||||||||||||||||||||||||||||||||||||||||||||||||
  1  AAPPSYFRGFTLIALRENREGDKEEDHAGTFQIIDEEETQFMSNCPVAVT   50

134  ESTPRRRTRIQVFWIAPPAGTGCVILKASIVQKRIIYFQDEGSLTKKLCE  183
     |||||||||||||||||||||||||||||||||||||||||||||||||
 51  ESTPRRRTRIQVFWIAPPAGTGCVILKASIVQKRIIYFQDEGSLTKKLCE  100

184  QDSTFDGVTDKPILDCCACGTAKYRLTFYGNWSEKTHPKDYPRRANHWSA  233
     |||||||||||||||||||||||||||||||||||||||||||||||||
101  QDSTFDGVTDKPILDCCACGTAKYRLTFYGNWSEKTHPKDYPRRANHWSA  150

234  IIGGSHSKNYVLWEYGGYASEGVKQVAELGSPVKMEEEIRQQSDEVLTVI  283
     |||||||||||||||||||||||||||||||||||||||||||||||||
151  IIGGSHSKNYVLWEYGGYASEGVKQVAELGSPVKMEEEIRQQSDEVLTVI  200

284  KAKAQWPAWQPLNV                                     297
     ||||||||||||||
201  KAKAQWPAWQPLNV                                     214
```

Sequence name: Q8NCD7

Sequence documentation:

Alignment of: M78530_PEA__1_P17 (SEQ ID NO: 428) x Q8NCD7 . . .

Alignment segment 1/1:
　Quality: 2705.00

Escore: 0
　Matching length: 275 Total length: 275

Matching Percent Similarity: 100.00 Matching Percent

1008

Identity: 100.00
　Total Percent Similarity: 100.00 Total Percent

Identity: 100.00
　Gaps: 0

Alignment:

```
  1  MRLSPAPLKLSRTPALLALALPLAAALAFSDETLDKVPKSEGYCSRILRA   50
     |||||||||||||||||||||||||||||||||||||||||||||||||
  1  MRLSPAPLKLSRTPALLALALPLAAALAFSDETLDKVPKSEGYCSRILRA   50

51  QGTRREGYTEFSLRVEGDPDFYKPGTSYRVTLSAAPPSYFRGFTLIALRE  100
     |||||||||||||||||||||||||||||||||||||||||||||||||
 51  QGTRREGYTEFSLRVEGDPDFYKPGTSYRVTLSAAPPSYFRGFTLIALRE  100

101  NREGDKEEDHAGTFQIIDEEETQFMSNCPVAVTESTPRRRTRIQVFWIAP  150
     |||||||||||||||||||||||||||||||||||||||||||||||||
101  NREGDKEEDHAGTFQIIDEEETQFMSNCPVAVTESTPRRRTRIQVFWIAP  150

151  PAGTGCVILKASIVQKRIIYFQDEGSLTKKLCEQDSTFDGVTDKPILDCC  200
     |||||||||||||||||||||||||||||||||||||||||||||||||
151  PAGTGCVILKASIVQKRIIYFQDEGSLTKKLCEQDSTFDGVTDKPILDCC  200

201  ACGTAKYRLTFYGNWSEKTHPKDYPRRANHWSAIIGGSHSKNYVLWEYGG  250
     |||||||||||||||||||||||||||||||||||||||||||||||||
201  ACGTAKYRLTFYGNWSEKTHPKDYPRRANHWSAIIGGSHSKNYVLWEYGG  250

251  YASEGVKQVAELGSPVKMEEEIRQQ                          275
     |||||||||||||||||||||||||
251  YASEGVKQVAELGSPVKMEEEIRQQ                          275
```

Sequence name: Q9HCB6

Sequence documentation:

Alignment of: M78530_PEA__1_P17 (SEQ ID NO: 428) x Q9HCB6 . . .

Alignment segment 1/1:
　Quality: 2705.00

Escore: 0
　Matching length: 275 Total length: 275

Matching Percent Similarity: 100.00 Matching Percent

Identity: 100.00
   Total Percent Similarity: 100.00 Total Percent
Identity: 100.00
   Gaps: 0

Alignment:

```
  1 MRLSPAPLKLSRTPALLALALPLAAALAFSDETLDKVPKSEGYCSRILRA  50
    ||||||||||||||||||||||||||||||||||||||||||||||||||
  1 MRLSPAPLKLSRTPALLALALPLAAALAFSDETLDKVPKSEGYCSRILRA  50

51 QGTRREGYTEFSLRVEGDPDFYKPGTSYRVTLSAAPPSYFRGFTLIALRE 100
    ||||||||||||||||||||||||||||||||||||||||||||||||||
 51 QGTRREGYTEFSLRVEGDPDFYKPGTSYRVTLSAAPPSYFRGFTLIALRE 100

101 NREGDKEEDHAGTFQIIDEEETQFMSNCPVAVTESTPRRRTRIQVFWIAP 150
    ||||||||||||||||||||||||||||||||||||||||||||||||||
101 NREGDKEEDHAGTFQIIDEEETQFMSNCPVAVTESTPRRRTRIQVFWIAP 150

151 PAGTGCVILKASIVQKRIIYFQDEGSLTKKLCEQDSTFDGVTDKPILDCC 200
    ||||||||||||||||||||||||||||||||||||||||||||||||||
151 PAGTGCVILKASIVQKRIIYFQDEGSLTKKLCEQDSTFDGVTDKPILDCC 200

201 ACGTAKYRLTFYGNWSEKTHPKDYPRRANHWSAIIGGSHSKNYVLWEYGG 250
    ||||||||||||||||||||||||||||||||||||||||||||||||||
201 ACGTAKYRLTFYGNWSEKTHPKDYPRRANHWSAIIGGSHSKNYVLWEYGG 250

251 YASEGVKQVAELGSPVKMEEEIRQQ                         275
    |||||||||||||||||||||||||
251 YASEGVKQVAELGSPVKMEEEIRQQ                         275
```

Sequence name: O94862

Sequence documentation:

Alignment of: M78530_PEA__1_P17 (SEQ ID NO: 428) x O94862 . . .

Alignment segment 1/1:
   Quality: 1914.00

Escore: 0
   Matching length: 192 Total length: 192

Matching Percent Similarity: 100.00 Matching Percent

Identity: 100.00
   Total Percent Similarity: 100.00 Total Percent

Identity: 100.00
   Gaps: 0

Alignment:

```
 84 AAPPSYFRGFTLIALRENREGDKEEDHAGTFQIIDEEETQFMSNCPVAVT 133
    ||||||||||||||||||||||||||||||||||||||||||||||||||
  1 AAPPSYFRGFTLIALRENREGDKEEDHAGTFQIIDEEETQFMSNCPVAVT  50

134 ESTPRRRTRIQVFWIAPPAGTGCVILKASIVQKRIIYFQDEGSLTKKLCE 183
    ||||||||||||||||||||||||||||||||||||||||||||||||||
 51 ESTPRRRTRIQVFWIAPPAGTGCVILKASIVQKRIIYFQDEGSLTKKLCE 100

184 QDSTFDGVTDKPILDCCACGTAKYRLTFYGNWSEKTHPKDYPRRANHWSA 233
    ||||||||||||||||||||||||||||||||||||||||||||||||||
101 QDSTFDGVTDKPILDCCACGTAKYRLTFYGNWSEKTHPKDYPRRANHWSA 150

234 IIGGSHSKNYVLWEYGGYASEGVKQVAELGSPVKMEEEIRQQ         275
    ||||||||||||||||||||||||||||||||||||||||||
151 IIGGSHSKNYVLWEYGGYASEGVKQVAELGSPVKMEEEIRQQ         192
```

DESCRIPTION FOR CLUSTER T48119

Cluster T48119 features 1 transcript(s) and 19 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| T48119_T2 | 429 |

TABLE 2

Segments of interest

| Segment Name | SEQ ID NO: |
|---|---|
| T48119_node_0 | 430 |
| T48119_node_11 | 431 |
| T48119_node_13 | 432 |
| T48119_node_38 | 433 |
| T48119_node_41 | 434 |
| T48119_node_45 | 435 |
| T48119_node_47 | 436 |
| T48119_node_4 | 437 |
| T48119_node_8 | 438 |
| T48119_node_15 | 439 |
| T48119_node_17 | 440 |
| T48119_node_20 | 441 |
| T48119_node_22 | 442 |
| T48119_node_26 | 443 |
| T48119_node_28 | 444 |
| T48119_node_31 | 445 |
| T48119_node_32 | 446 |
| T48119_node_33 | 447 |
| T48119_node_44 | 448 |

TABLE 3

Proteins of interest

| Protein Name | SEQ ID NO: | Corresponding Transcript(s) |
|---|---|---|
| T48119_P2 | 450 | T48119_T2 (SEQ ID NO:429) |

These sequences are variants of the known protein Programmed cell death protein 8, mitochondrial precursor (SwissProt accession identifier PCD8_HUMAN; known also according to the synonyms Apoptosis-inducing factor), SEQ ID NO: 449, referred to herein as the previously known protein.

Protein Programmed cell death protein 8, mitochondrial precursor is known or believed to have the following function(s): Probable oxidoreductase that acts as a caspase-independent mitochondrial effector of apoptotic cell death. Extramitochondrial aif induces nuclear chromatin condensation and large scale DNA fragmentation (in vitro). The sequence for protein Programmed cell death protein 8, mitochondrial precursor is given at the end of the application, as "Programmed cell death protein 8, mitochondrial precursor amino acid sequence". Known polymorphisms for this sequence are as shown in Table 4.

TABLE 4

Amino acid mutations for Known Protein

| SNP position(s) on amino acid sequence | Comment |
|---|---|
| 36-57 | GNLFQRWHVPLELQMTRQMASS -> VVQSHHLGSPSRSLA ST |
| 62-70 | GKIDNSVLV -> KDGSNLVYF |
| 75-78 | LSTV -> ATVT |
| 82 | A -> VY |

Protein Programmed cell death protein 8, mitochondrial precursor localization is believed to be mitochondrial intermembrane space. Translocated to the nucleus upon induction of apoptosis.

The following GO Annotation(s) apply to the previously known protein. The following annotation(s) were found: electron transport; DNA fragmentation; apoptosis; induction of apoptosis by DNA damage, which are annotation(s) related to Biological Process; electron carrier; disulfide oxidoreductase, which are annotation(s) related to Molecular Function; and nucleus; mitochondrion, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLinkl>.

Cluster T48119 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 41 refer to weighted expression of ESTs in each category, as "parts per million" (ratio of the expression of ESTs for a particular cluster to the expression of all ESTs in that category, according to parts per million).

Figure 41:
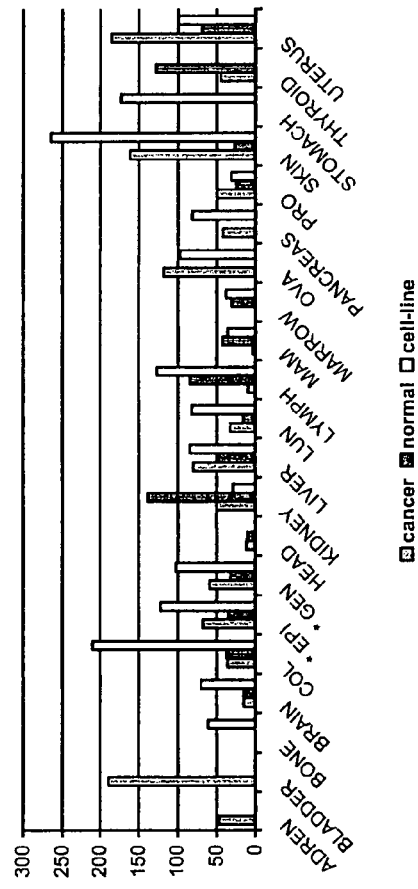
FIG. 41 shows cancer and cell-line vs. normal tissue expression.

Overall, the following results were obtained as shown with regard to the histograms in FIG. 41 and Table 5. This cluster is overexpressed (at least at a minimum level) in the following pathological conditions: epithelial malignant tumors and a mixture of malignant tumors from different tissues.

TABLE 5

Normal tissue distribution

| Name of Tissue | Number |
|---|---|
| adrenal | 0 |
| bladder | 0 |
| bone | 0 |
| brain | 14 |
| colon | 37 |
| epithelial | 35 |
| general | 32 |
| head and neck | 10 |
| kidney | 139 |
| liver | 48 |
| lung | 15 |
| lymph nodes | 84 |
| breast | 43 |
| bone marrow | 31 |
| ovary | 0 |
| pancreas | 0 |
| prostate | 24 |
| skin | 26 |
| stomach | 0 |
| Thyroid | 128 |
| uterus | 68 |

TABLE 6

P values and ratios for expression in cancerous tissue

| Name of Tissue | P1 | P2 | SP1 | R3 | SP2 | R4 |
|---|---|---|---|---|---|---|
| adrenal | 4.2e-01 | 4.6e-01 | 4.6e-01 | 2.2 | 5.3e-01 | 1.9 |
| bladder | 1.5e-01 | 2.1e-01 | 3.2e-02 | 4.1 | 9.9e-02 | 2.9 |
| bone | 1 | 1.7e-01 | 1 | 1.0 | 3.4e-01 | 2.4 |
| brain | 7.8e-01 | 4.8e-01 | 7.1e-01 | 1.0 | 7.2e-02 | 2.4 |
| colon | 5.7e-01 | 4.5e-01 | 7.8e-01 | 1.0 | 3.0e-01 | 1.2 |
| epithelial | 2.1e-02 | 2.3e-03 | 7.3e-03 | 1.8 | 9.0e-07 | 2.3 |
| general | 2.4e-02 | 3.8e-04 | 6.1e-04 | 1.7 | 2.9e-11 | 2.2 |
| head and neck | 4.6e-01 | 6.2e-01 | 1 | 1.0 | 1 | 0.9 |
| kidney | 7.9e-01 | 8.3e-01 | 9.7e-01 | 0.4 | 9.9e-01 | 0.4 |
| liver | 3.3e-01 | 6.0e-01 | 1 | 1.3 | 6.4e-01 | 1.1 |
| lung | 8.5e-01 | 5.2e-01 | 3.7e-01 | 1.7 | 5.8e-02 | 2.5 |

TABLE 6-continued

P values and ratios for expression in cancerous tissue

| Name of Tissue | P1 | P2 | SP1 | R3 | SP2 | R4 |
|---|---|---|---|---|---|---|
| lymph nodes | 6.9e−01 | 5.2e−01 | 1 | 0.3 | 5.7e−01 | 0.7 |
| breast | 5.0e−01 | 3.9e−01 | 1 | 0.5 | 9.2e−01 | 0.7 |
| bone marrow | 8.6e−01 | 8.5e−01 | 1 | 0.5 | 7.8e−01 | 1.0 |
| ovary | 4.5e−02 | 2.0e−02 | 6.9e−02 | 3.8 | 7.0e−02 | 3.7 |
| pancreas | 1.2e−01 | 8.7e−02 | 7.6e−02 | 5.1 | 2.1e−02 | 5.5 |
| prostate | 8.6e−01 | 8.3e−01 | 3.6e−01 | 1.4 | 4.4e−01 | 1.3 |
| skin | 1.0e−01 | 3.1e−02 | 1.0e−01 | 4.4 | 2.6e−05 | 2.9 |
| stomach | 9.1e−01 | 2.1e−01 | 1 | 1.0 | 4.3e−02 | 4.0 |
| Thyroid | 4.6e−01 | 4.6e−01 | 1 | 0.7 | 1 | 0.7 |
| uterus | 1.2e−02 | 3.3e−02 | 7.3e−02 | 2.0 | 1.6e−01 | 1.6 |

As noted above, cluster T48119 features 1 transcript(s), which were listed in Table 1 above. These transcript(s) encode for protein(s) which are variant(s) of protein Programmed cell death protein 8, mitochondrial precursor. A description of each variant protein according to the present invention is now provided.

Variant protein T48119_P2 (SEQ ID NO: 450) according to the present invention has an amino acid sequence as given at the end of the application; it is encoded by transcript(s) T48119_T2 (SEQ ID NO: 429). An alignment is given to the known protein (Programmed cell death protein 8, mitochondrial precursor) at the end of the application. One or more alignments to one or more previously published protein sequences are given at the end of the application. A brief description of the relationship of the variant protein according to the present invention to each such aligned protein is as follows:

Comparison report between T48119_P2 (SEQ ID NO: 450) and PCD8_HUMAN:

1. An isolated chimeric polypeptide encoding for T48119_P2 (SEQ ID NO: 450), comprising a first amino acid sequence being at least 90% homologous to MTRQMASSGASGGKIDNSVLVLIVGLSTVGAGAYAYKTMKEDEKRYNERISGLGLTPE QKQKKAALSASEGEEVPQDKAPSHVPFLLIGGGTAAFAAARSIRARDPGARVLIVSEDP ELPYMRPPLSKELWFSDDPNVTKTLRFKQWNGKERSIYFQPPSFYVSAQDLPHIENGGV AVLTGKKVVQLDVRDNMVKLNDGSQITYEKCLIATGGTPRSLSAIDRAGAEVKS RTTL FRKIGDFRSLEKISREVKSITIIGGGFLGSELACALGRKARALGTEVIQLFPEKGNMGKILP EYLSNWTMEKVRREGVKVMPNAIVQSVGVSSGKLLIKLKDGRKVETDHIVAAVGLEP NVELAKTGGLEIDSDFGGFRVNAELQARSNIWVAGDAACFYDIKLGRRRVEHHDHAV VSGRLAGENMTGAAKPYWHQSMFWSDLGPDVGYEAIGLVDSSLPTVGVFAKATAQD NPKSATEQSGTGIRSESETESEASEITIPPSTPAVPQAPVQGEDYGKGVIFYLRDKVVVGI VLWNIFNRMPIARKIIKDGEQHEDLNEVAKLFNIHED corresponding to amino acids 50-613 of PCD8_HUMAN, which also corresponds to amino acids 1-564 of T48119_P2 (SEQ ID NO: 450).

The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Signal peptide,NN:NO) predicts that this protein has a signal peptide.

Variant protein T48119_P2 (SEQ ID NO: 450) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein T48119_P2 (SEQ ID NO: 450) sequence provides support for the deduced sequence of this variant protein according to the present invention).

TABLE 7

Amino acid mutations

| SNP position(s) on amino acid sequence | Alternative amino acid(s) | Previously known SNP? |
|---|---|---|
| 124 | P −> | No |
| 124 | P −> T | No |
| 308 | R −> I | No |
| 507 | Q −> | No |
| 545 | D −> A | No |

Variant protein T48119_P2 (SEQ ID NO: 450) is encoded by the following transcript(s): T48119_T2 (SEQ ID NO: 429), for which the sequence(s) is/are given at the end of the application. The coding portion of transcript T48119_T2 (SEQ ID NO: 429) is shown in bold; this coding portion starts at position 227 and ends at position 1918. The transcript also has the following SNPs as listed in Table 8 (given according to their position on the nucleotide sequence, with the alternative nucleic acid listed; the last column indicates whether the SNP is known or not; the presence of known SNPs in variant protein T48119_P2 (SEQ ID NO: 450) sequence provides support for the deduced sequence of this variant protein according to the present invention).

TABLE 8

Nucleic acid SNPs

| SNP position on nucleotide sequence | Alternative nucleic acid | Previously known SNP? |
|---|---|---|
| 352 | C −> T | Yes |
| 596 | C −> | No |
| 596 | C −> A | No |
| 766 | −> G | No |
| 997 | C −> T | Yes |
| 1075 | A −> G | Yes |
| 1149 | G −> T | No |
| 1747 | G −> | No |
| 1786 | G −> A | Yes |
| 1860 | A −> C | No |

As noted above, cluster T48119 features 19 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T48119_node_0 (SEQ ID NO: 430) according to the present invention is supported by 81 libraries. The number of libraries was determined as previously described. This segment can be found in the following transcript(s): T48119_T2 (SEQ ID NO: 429). Table 9 below describes the starting and ending position of this segment on each transcript.

TABLE 9

Segment location on transcripts

| Transcript name | Segment starting position | Segment ending position |
|---|---|---|
| T48119_T2 (SEQ ID NO:429) | 1 | 226 |

Segment cluster T48119_node__11 (SEQ ID NO: 431) according to the present invention is supported by 77 libraries. The number of libraries was determined as previously described. This segment can be found in the following transcript(s): T48119_T2 (SEQ ID NO: 429). Table 10 below describes the starting and ending position of this segment on each transcript.

TABLE 10

Segment location on transcripts

| Transcript name | Segment starting position | Segment ending position |
|---|---|---|
| T48119_T2 (SEQ ID NO:429) | 429 | 553 |

Segment cluster T48119_node__13 (SEQ ID NO: 432) according to the present invention is supported by 74 libraries. The number of libraries was determined as previously described. This segment can be found in the following transcript(s): T48119_T2 (SEQ ID NO: 429). Table 11 below describes the starting and ending position of this segment on each transcript.

TABLE 11

Segment location on transcripts

| Transcript name | Segment starting position | Segment ending position |
|---|---|---|
| T48119_T2 (SEQ ID NO:429) | 554 | 684 |

Segment cluster T48119_node__38 (SEQ ID NO: 433) according to the present invention is supported by 119 libraries. The number of libraries was determined as previously described. This segment can be found in the following transcript(s): T48119_T2 (SEQ ID NO: 429). Table 12 below describes the starting and ending position of this segment on each transcript.

TABLE 12

Segment location on transcripts

| Transcript name | Segment starting position | Segment ending position |
|---|---|---|
| T48119_T2 (SEQ ID NO:429) | 1385 | 1527 |

Segment cluster T48119_node__41 (SEQ ID NO: 434) according to the present invention is supported by 128 libraries. The number of libraries was determined as previously described. This segment can be found in the following transcript(s): T48119_T2 (SEQ ID NO: 429). Table 13 below describes the starting and ending position of this segment on each transcript.

TABLE 13

Segment location on transcripts

| Transcript name | Segment starting position | Segment ending position |
|---|---|---|
| T48119_T2 (SEQ ID NO:429) | 1528 | 1652 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in regard to ovarian cancer), shown in Table 14.

TABLE 14

Oligonucleotides related to this segment

| Oligonucleotide name | Overexpressed in cancers | Chip reference |
|---|---|---|
| T99761_0_13_0 | ovarian carcinoma | OVA |

Segment cluster T48119_node__45 (SEQ ID NO: 435) according to the present invention is supported by 138 libraries. The number of libraries was determined as previously described. This segment can be found in the following transcript(s): T48119_T2 (SEQ ID NO: 429). Table 15 below describes the starting and ending position of this segment on each transcript.

TABLE 15

Segment location on transcripts

| Transcript name | Segment starting position | Segment ending position |
|---|---|---|
| T48119_T2 (SEQ ID NO:429) | 1717 | 1849 |

Segment cluster T48119_node__47 (SEQ ID NO: 436) according to the present invention is supported by 129 libraries. The number of libraries was determined as previously described. This segment can be found in the following transcript(s): T48119_T2 (SEQ ID NO: 429). Table 16 below describes the starting and ending position of this segment on each transcript.

TABLE 16

Segment location on transcripts

| Transcript name | Segment starting position | Segment ending position |
|---|---|---|
| T48119_T2 (SEQ ID NO:429) | 1850 | 2113 |

According to an optional embodiment of the present invention, short segments related to the above cluster are also provided. These segments are up to about 120 bp in length, and so are included in a separate description.

Segment cluster T48119_node_4 (SEQ ID NO: 437) according to the present invention is supported by 81 libraries. The number of libraries was determined as previously described. This segment can be found in the following transcript(s): T48119_T2 (SEQ ID NO: 429). Table 17 below describes the starting and ending position of this segment on each transcript.

TABLE 17

Segment location on transcripts

| Transcript name | Segment starting position | Segment ending position |
|---|---|---|
| T48119_T2 (SEQ ID NO:429) | 227 | 328 |

Segment cluster T48119_node_8 (SEQ ID NO: 438) according to the present invention is supported by 79 libraries. The number of libraries was determined as previously described. This segment can be found in the following transcript(s): T48119_T2 (SEQ ID NO: 429). Table 18 below describes the starting and ending position of this segment on each transcript.

TABLE 18

Segment location on transcripts

| Transcript name | Segment starting position | Segment ending position |
|---|---|---|
| T48119_T2 (SEQ ID NO:429) | 329 | 428 |

Segment cluster T48119_node_15 (SEQ ID NO: 439) according to the present invention is supported by 64 libraries. The number of libraries was determined as previously described. This segment can be found in the following transcript(s): T48119_T2 (SEQ ID NO: 429). Table 19 below describes the starting and ending position of this segment on each transcript.

TABLE 19

Segment location on transcripts

| Transcript name | Segment starting position | Segment ending position |
|---|---|---|
| T48119_T2 (SEQ ID NO:429) | 685 | 775 |

Segment cluster T48119_node_17 (SEQ ID NO: 440) according to the present invention is supported by 59 libraries. The number of libraries was determined as previously described. This segment can be found in the following transcript(s): T48119_T2 (SEQ ID NO: 429). Table 20 below describes the starting and ending position of this segment on each transcript.

TABLE 20

Segment location on transcripts

| Transcript name | Segment starting position | Segment ending position |
|---|---|---|
| T48119_T2 (SEQ ID NO:429) | 776 | 860 |

Segment cluster T48119_node_20 (SEQ ID NO: 441) according to the present invention is supported by 64 libraries. The number of libraries was determined as previously described. This segment can be found in the following transcript(s): T48119_T2 (SEQ ID NO: 429). Table 21 below describes the starting and ending position of this segment on each transcript.

TABLE 21

Segment location on transcripts

| Transcript name | Segment starting position | Segment ending position |
|---|---|---|
| T48119_T2 (SEQ ID NO:429) | 861 | 937 |

Segment cluster T48119_node_22 (SEQ ID NO: 442) according to the present invention is supported by 73 libraries. The number of libraries was determined as previously described. This segment can be found in the following transcript(s): T48119_T2 (SEQ ID NO: 429). Table 22 below describes the starting and ending position of this segment on each transcript.

TABLE 22

Segment location on transcripts

| Transcript name | Segment starting position | Segment ending position |
|---|---|---|
| T48119_T2 (SEQ ID NO:429) | 938 | 1046 |

Segment cluster T48119_node_26 (SEQ ID NO: 443) according to the present invention is supported by 86 libraries. The number of libraries was determined as previously described. This segment can be found in the following transcript(s): T48119_T2 (SEQ ID NO: 429). Table 23 below describes the starting and ending position of this segment on each transcript.

TABLE 23

Segment location on transcripts

| Transcript name | Segment starting position | Segment ending position |
|---|---|---|
| T48119_T2 (SEQ ID NO:429) | 1047 | 1154 |

Segment cluster T48119_node_28 (SEQ ID NO: 444) according to the present invention is supported by 83 libraries. The number of libraries was determined as previously described. This segment can be found in the following transcript(s): T48119_T2 (SEQ ID NO: 429). Table 24 below describes the starting and ending position of this segment on each transcript.

TABLE 24

Segment location on transcripts

| Transcript name | Segment starting position | Segment ending position |
|---|---|---|
| T48119_T2 (SEQ ID NO:429) | 1155 | 1243 |

Segment cluster T48119_node_31 (SEQ ID NO: 445) according to the present invention is supported by 83 libraries. The number of libraries was determined as previously described. This segment can be found in the following transcript(s): T48119_T2 (SEQ ID NO: 429). Table 25 below describes the starting and ending position of this segment on each transcript.

TABLE 25

Segment location on transcripts

| Transcript name | Segment starting position | Segment ending position |
|---|---|---|
| T48119_T2 (SEQ ID NO:429) | 1244 | 1304 |

Segment cluster T48119_node_32 (SEQ ID NO: 446) according to the present invention can be found in the following transcript(s): T48119_T2 (SEQ ID NO: 429). Table 26 below describes the starting and ending position of this segment on each transcript.

TABLE 26

Segment location on transcripts

| Transcript name | Segment starting position | Segment ending position |
|---|---|---|
| T48119_T2 (SEQ ID NO:429) | 1305 | 1328 |

Segment cluster T48119_node_33 (SEQ ID NO: 447) according to the present invention is supported by 89 libraries. The number of libraries was determined as previously described. This segment can be found in the following transcript(s): T48119_T2 (SEQ ID NO: 429). Table 27 below describes the starting and ending position of this segment on each transcript.

TABLE 27

Segment location on transcripts

| Transcript name | Segment starting position | Segment ending position |
|---|---|---|
| T48119_T2 (SEQ ID NO:429) | 1329 | 1384 |

Segment cluster T48119_node_44 (SEQ ID NO: 448) according to the present invention is supported by 140 libraries. The number of libraries was determined as previously described. This segment can be found in the following transcript(s): T48119_T2 (SEQ ID NO: 429). Table 28 below describes the starting and ending position of this segment on each transcript.

TABLE 28

Segment location on transcripts

| Transcript name | Segment starting position | Segment ending position |
|---|---|---|
| T48119_T2 (SEQ ID NO:429) | 1653 | 1716 |

Variant protein alignment to the previously known protein:

Sequence name: PCD8_HUMAN

Sequence documentation:

Alignment of: T48119_P2 (SEQ ID NO: 450) x PCD8_HUMAN . . .

Alignment segment 1/1:
  Quality: 5416.00

Escore: 0
  Matching length: 564 Total length: 564

Matching Percent Similarity: 100.00 Matching Percent Identity: 100.00
  Total Percent Similarity: 100.00 Total Percent Identity: 100.00
  Gaps: 0

Alignment:

```
  1 MTRQMASSGASGGKIDNSVLVLIVGLSTVGAGAYAYKTMKEDEKRYNERI  50
    |||||||||||||||   |||||||||||||||||||||||||||||||
 50 MTRQMASSGASGGLODMSVLVLIVGLSTVGAGAYAYKTMKEDEKRYNERI  99

51 SGLGLTPEQKQKKAALSASEGEEVPQDKAPSHVPFLLIGGGTAAFAAARS 100
    |||||||||||||||||||||||||||||||||||||||||||||||||
100 SGLGLTPEQKQKKAALSASEGEEVPQDKAPSHVPFLLIGGGTAAFAAARS 149

101 IRARDPGARVLIVSEDPELPYMRPPLSKELWFSDDPNVTKTLRFKQWNGK 150
    |||||||||||||||||||||||||||||||||||||||||||||||||
150 IRARDPGARVLIVSEDPELPYMRPPLSKELWFSDDPNVTKTLRFKQWNGK 199

151 ERSIYFQPPSFYVSAQDLPHIENGGVAVLTGKKVVQLDVRDNMVKLNDGS 200
    ||||||||||||||||||||||||||||||||||| |||||||||||||
200 ERSIYFQPPSFYVSAQDLPHIENGGVAVLTGKKVVQKDVRDNMVKLNDGS 249
```

```
-continued
201 QITYEKCLIATGGTPRSLSAIDRAGAEVKSRTTLFRKIGDFRSLEKISRE 250
    ||||||||||||||||||||||||||||||||||||||||||||||||||
250 QITYEKCLIATGGTPRSLSAIDRAGAEVKSRTTLFRKIGDFRSLEKISRE 299

251 VKSITIIGGGFLGSELACALGRKARALGTEVIQLFPEKGNMGKILPEYLS 300
    ||||||||||||||||||||||||||||||||||||||||||||||||||
300 VKSITIIGGGFLGSELACALGRKARALGTEVIQLFPEKGNMGKILPEYLS 349

301 NWTMEKVRREGVKVMPNAIVQSVGVSSGKLLIKLKDGRKVETDHIVAAVG 350
    ||||||||||||||||||||||||||||||||||||||||||||||||||
350 NWTMEKVRREGVKVMPNAIVQSVGVSSGKLLIKLKDGRKVETDHIVAAVG 399

351 LEPNVELAKTGGLEIDSDFGGFRVNAELQARSNIWVAGDAACFYDIKLGR 400
    ||||||||||||||||||||||||||||||||||||||||||||||||||
400 LEPNVELAKTGGLEIDSDFGGFRVNAELQARSNIWVAGDAACFYDIKLGR 449

401 RRVEHHDHAVVSGRLAGENMTGAAKPYWHQSMFWSDLGPDVGYEAIGLVD 450
    ||||||||||||||||||||||||||||||||||||||||||||||||||
450 RRVEHHDHAVVSGRLAGENMTGAAKPYWHQSMFWSDLGPDVGYEAIGLVD 499

451 SSLPTVGVFAKATAQDNPKSATEQSGTGIRSESETESEASEITIPPSTPA 500
    ||||||||||||||||||||||||||||||||||||||||||||||||||
500 SSLPTVGVFAKATAQDNPKSATEQSGTGIRSESETESEASEITIPPSTPA 549

501 VPQAPVQGEDYGKGVIFYLRDKVVVGIVLWNIFNRMPIARKIIKDGEQHE 550
    ||||||||||||||||||||||||||||||||||||||||||||||||||
550 VPQAPVQGEDYGKGVIFYLRDKVVVGIVLWNIFNRMPIARKIIKDGEQHE 599

551 DLNEVAKLFNIHED                                     564
    ||||||||||||||
600 DLNEVAKLFNIHED                                     613
```

DESCRIPTION FOR CLUSTER HSMUC1A

Cluster HSMUC1A features 14 transcript(s) and 22 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| HSMUC1A_PEA_1_T12 | 451 |
| HSMUC1A_PEA_1_T26 | 452 |
| HSMUC1A_PEA_1_T28 | 453 |
| HSMUC1A_PEA_1_T29 | 454 |
| HSMUC1A_PEA_1_T30 | 455 |
| HSMUC1A_PEA_1_T31 | 456 |
| HSMUC1A_PEA_1_T33 | 457 |
| HSMUC1A_PEA_1_T34 | 458 |
| HSMUC1A_PEA_1_T35 | 459 |
| HSMUC1A_PEA_1_T36 | 460 |
| HSMUC1A_PEA_1_T40 | 461 |
| HSMUC1A_PEA_1_T42 | 462 |
| HSMUC1A_PEA_1_T43 | 463 |
| HSMUC1A_PEA_1_T47 | 464 |

TABLE 2

Segments of interest

| Segment Name | SEQ ID NO: |
|---|---|
| HSMUC1A_PEA_1_node_0 | 465 |
| HSMUC1A_PEA_1_node_14 | 466 |
| HSMUC1A_PEA_1_node_24 | 467 |
| HSMUC1A_PEA_1_node_29 | 468 |
| HSMUC1A_PEA_1_node_35 | 469 |
| HSMUC1A_PEA_1_node_38 | 470 |

TABLE 2-continued

Segments of interest

| Segment Name | SEQ ID NO: |
|---|---|
| HSMUC1A_PEA_1_node_3 | 471 |
| HSMUC1A_PEA_1_node_4 | 472 |
| HSMUC1A_PEA_1_node_5 | 473 |
| HSMUC1A_PEA_1_node_6 | 474 |
| HSMUC1A_PEA_1_node_7 | 475 |
| HSMUC1A_PEA_1_node_17 | 476 |
| HSMUC1A_PEA_1_node_18 | 477 |
| HSMUC1A_PEA_1_node_20 | 478 |
| HSMUC1A_PEA_1_node_21 | 479 |
| HSMUC1A_PEA_1_node_23 | 480 |
| HSMUC1A_PEA_1_node_26 | 481 |
| HSMUC1A_PEA_1_node_27 | 482 |
| HSMUC1A_PEA_1_node_31 | 483 |
| HSMUC1A_PEA_1_node_34 | 484 |
| HSMUC1A_PEA_1_node_36 | 485 |
| HSMUC1A_PEA_1_node_37 | 486 |

TABLE 3

Proteins of interest

| Protein Name | SEQ ID NO: | Corresponding Transcript(s) |
|---|---|---|
| HSMUC1A_PEA_1_P25 | 488 | HSMUC1A_PEA_1_T26 (SEQ ID NO: 452) |
| HSMUC1A_PEA_1_P29 | 489 | HSMUC1A_PEA_1_T33 (SEQ ID NO: 457) |
| HSMUC1A_PEA_1_P30 | 490 | HSMUC1A_PEA_1_T34 (SEQ ID NO: 458) |
| HSMUC1A_PEA_1_P32 | 491 | HSMUC1A_PEA_1_T36 (SEQ ID NO: 460) |
| HSMUC1A_PEA_1_P36 | 492 | HSMUC1A_PEA_1_T40 (SEQ ID NO: 461) |
| HSMUC1A_PEA_1_P39 | 493 | HSMUC1A_PEA_1_T43 (SEQ ID NO: 463) |

TABLE 3-continued

Proteins of interest

| Protein Name | SEQ ID NO: | Corresponding Transcript(s) |
|---|---|---|
| HSMUC1A_PEA_1_P45 | 494 | HSMUC1A_PEA_1_T29 (SEQ ID NO: 454) |
| HSMUC1A_PEA_1_P49 | 495 | HSMUC1A_PEA_1_T12 (SEQ ID NO: 451) |
| HSMUC1A_PEA_1_P52 | 496 | HSMUC1A_PEA_1_T30 (SEQ ID NO: 455) |
| HSMUC1A_PEA_1_P53 | 497 | HSMUC1A_PEA_1_T31 (SEQ ID NO: 456) |
| HSMUC1A_PEA_1_P56 | 498 | HSMUC1A_PEA_1_T42 (SEQ ID NO: 462) |
| HSMUC1A_PEA_1_P58 | 499 | HSMUC1A_PEA_1_T35 (SEQ ID NO: 459) |
| HSMUC1A_PEA_1_P59 | 500 | HSMUC1A_PEA_1_T28 (SEQ ID NO: 453) |
| HSMUC1A_PEA_1_P63 | 501 | HSMUC1A_PEA_1_T47 (SEQ ID NO: 464) |

These sequences are variants of the known protein Mucin 1 precursor (SwissProt accession identifier MUC1_HUMAN; known also according to the synonyms MUC-1; Polymorphic epithelial mucin; PEM; PEMT; Episialin; Tumor-associated mucin; Carcinoma-associated mucin; Tumor-associated epithelial membrane antigen; EMA; H23AG; Peanut-reactive urinary mucin; PUM; Breast carcinoma-associated antigen DF3; CD227 antigen), SEQ ID NO: 487, referred to herein as the previously known protein.

Protein Mucin 1 precursor is known or believed to have the following function(s): May play a role in adhesive functions and in cell-cell interactions, metastasis and signaling. May provide a protective layer on epithelial surfaces. Direct or indirect interaction with actin cytoskeleton. Isoform 7 behaves as a receptor and binds the secreted isoform 5. The binding induces the phosphorylation of the isoform 7, alters cellular morphology and initiates cell signaling. Can bind to GRB2 adapter protein. The sequence for protein Mucin 1 precursor is given at the end of the application, as "Mucin 1 precursor amino acid sequence". Known polymorphisms for this sequence are as shown in Table 4.

TABLE 4

Amino acid mutations for Known Protein

| SNP position(s) on amino acid sequence | Comment |
|---|---|
| 1116 | D -> E: NO EFFECT ON BINDING OF ISOFORM 7. |
| 1116 | D -> A: DRASTICALLY REDUCED BINDING OF ISOFORM 7. |
| 2 | T -> A |
| 134 | P -> Q |
| 154 | P -> Q |
| 1021 | S -> T |
| 1117 | V -> M |
| 1193 | Q -> L |
| 1231 | K -> T |
| 1251 | A -> T |

Protein Mucin 1 precursor localization is believed to be Type I membrane protein. Two secreted forms (5 and 9) are also produced.

The previously known protein also has the following indication(s) and/or potential therapeutic use(s): Cancer, breast; Cancer, lung, non-small cell; Cancer, ovarian; Cancer, prostate; Cancer. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: CD8 agonist; DNA antagonist; Immunostimulant; Interferon gamma agonist; MUC-1 inhibitor. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer; Monoclonal antibody, murine; Immunotoxin; Immunostimulant; Immunoconjugate.

The following GO Annotation(s) apply to the previously known protein. The following annotation(s) were found: actin binding, which are annotation(s) related to Molecular Function; and cytoskeleton; integral plasma membrane protein, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster HSMUC1A can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 42 refer to weighted expression of ESTs in each category, as "parts per million" (ratio of the expression of ESTs for a particular cluster to the expression of all ESTs in that category, according to parts per million).

Figure 42:
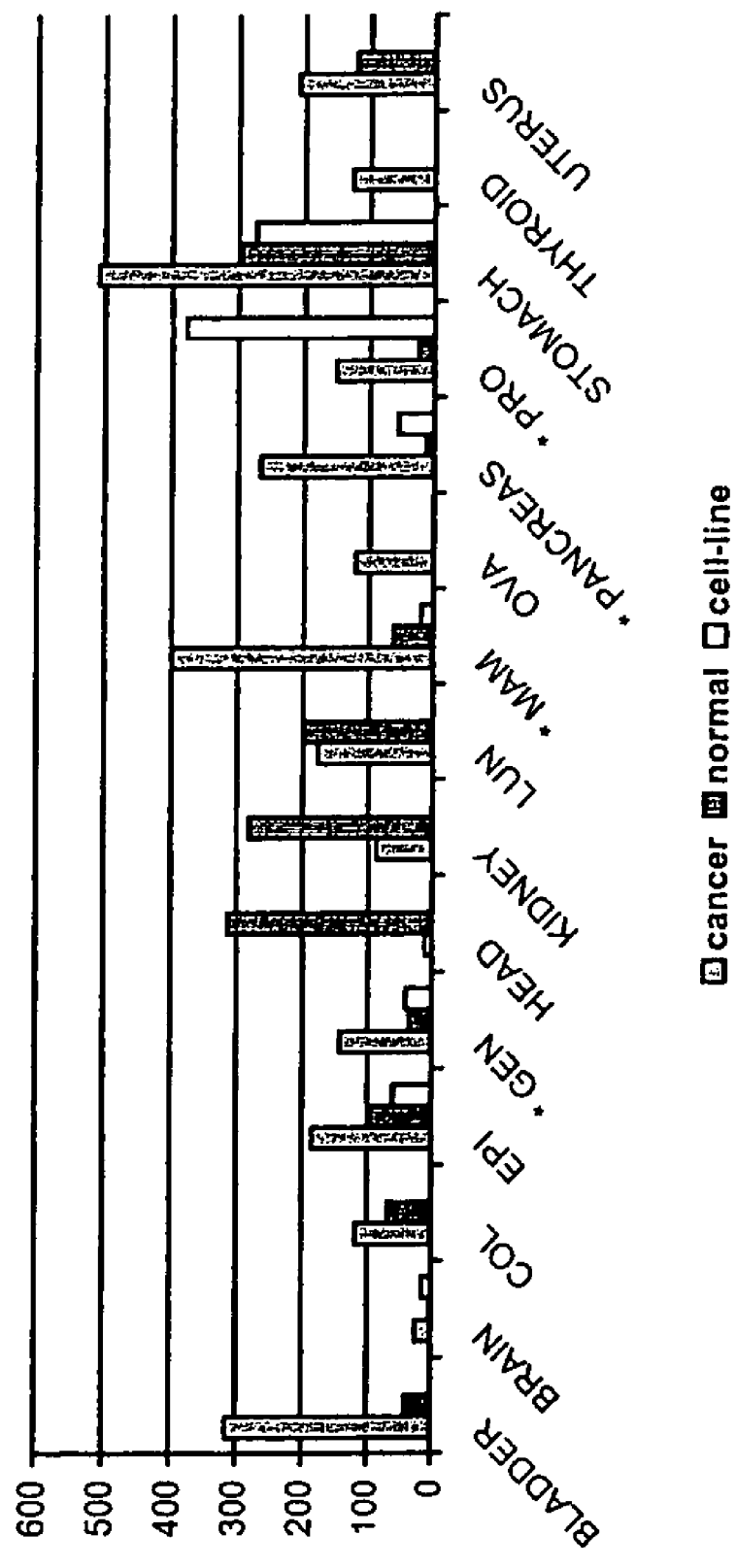
FIG. 42 shows cancer and cell-line vs. normal tissue expression.

Overall, the following results were obtained as shown with regard to the histograms in FIG. 42 and Table 5. This cluster is overexpressed (at least at a minimum level) in the following pathological conditions: a mixture of malignant tumors from different tissues, breast malignant tumors, pancreas carcinoma and prostate cancer.

TABLE 5

Normal tissue distribution

| Name of Tissue | Number |
|---|---|
| bladder | 41 |
| brain | 2 |
| colon | 66 |
| epithelial | 96 |
| general | 36 |
| head and neck | 314 |
| kidney | 282 |
| lung | 200 |
| breast | 61 |
| ovary | 0 |
| pancreas | 12 |
| prostate | 24 |
| stomach | 296 |
| Thyroid | 0 |
| uterus | 122 |

TABLE 6

P values and ratios for expression in cancerous tissue

| Name of Tissue | P1 | P2 | SP1 | R3 | SP2 | R4 |
|---|---|---|---|---|---|---|
| bladder | 3.3e−01 | 4.5e−01 | 1.8e−02 | 2.4 | 8.9e−02 | 1.7 |
| brain | 3.0e−02 | 2.6e−02 | 1.2e−01 | 4.6 | 1.1e−01 | 3.9 |

TABLE 6-continued

P values and ratios for expression in cancerous tissue

| Name of Tissue | P1 | P2 | SP1 | R3 | SP2 | R4 |
|---|---|---|---|---|---|---|
| colon | 1.2e−01 | 2.4e−01 | 3.8e−01 | 1.6 | 5.9e−01 | 1.2 |
| epithelial | 5.4e−02 | 6.0e−01 | 7.3e−06 | 1.8 | 6.2e−02 | 1.1 |
| general | 6.5e−07 | 2.6e−03 | 4.0e−23 | 3.6 | 1.7e−12 | 2.3 |
| head and neck | 6.4e−01 | 7.2e−01 | 1 | 0.3 | 1 | 0.3 |
| kidney | 7.8e−01 | 8.1e−01 | 1 | 0.3 | 1 | 0.2 |
| lung | 7.6e−01 | 7.9e−01 | 6.7e−01 | 0.8 | 1 | 0.4 |
| breast | 8.2e−02 | 1.3e−01 | 4.1e−03 | 3.6 | 7.7e−02 | 2.0 |
| ovary | 3.0e−02 | 4.3e−02 | 6.9e−02 | 4.4 | 1.6e−01 | 3.2 |
| pancreas | 7.2e−02 | 1.4e−01 | 9.6e−07 | 5.4 | 1.5e−05 | 4.5 |
| prostate | 7.0e−01 | 6.0e−01 | 1.5e−02 | 1.4 | 6.9e−04 | 3.2 |
| stomach | 3.1e−01 | 7.1e−01 | 1.5e−01 | 0.4 | 4.6e−01 | 0.8 |
| Thyroid | 2.9e−01 | 2.9e−01 | 4.4e−01 | 2.0 | 4.4e−01 | 2.0 |
| uterus | 2.4e−01 | 6.5e−01 | 1.6e−01 | 1.0 | 7.0e−01 | 0.6 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below (in regard to ovarian cancer), shown in Table 7.

TABLE 7

Oligonucleotides related to this cluster

| Oligonucleotide name | Overexpressed in cancers | Chip reference |
|---|---|---|
| HSMUC1A_0_0_11364 | ovarian carcinoma | OVA |

As noted above, cluster HSMUC1A features 14 transcript(s), which were listed in Table 1 above. These transcript(s) encode for protein(s) which are variant(s) of protein Mucin 1 precursor. A description of each variant protein according to the present invention is now provided.

Variant protein HSMUC1A_PEA_1_P25 (SEQ ID NO: 488) according to the present invention has an amino acid sequence as given at the end of the application; it is encoded by transcript(s) HSMUC1A_PEA_1_T26 (SEQ ID NO: 452). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide.

Variant protein HSMUC1A_PEA_1_P25 (SEQ ID NO: 488) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein HSMUC1A_PEA_1_P25 (SEQ ID NO: 488) sequence provides support for the deduced sequence of this variant protein according to the present invention).

TABLE 8

Amino acid mutations

| SNP position(s) on amino acid sequence | Alternative amino acid(s) | Previously known SNP? |
|---|---|---|
| 90 | S −> N | Yes |
| 91 | D −> N | No |
| 157 | Y −> | No |
| 187 | S −> G | No |

Variant protein HSMUC1A_PEA_1_P25 (SEQ ID NO: 488) is encoded by the following transcript(s): HSMUC1A_PEA_1_T26 (SEQ ID NO: 452), for which the sequence(s) is/are given at the end of the application. The coding portion of transcript HSMUC1A_PEA_1_T26 (SEQ ID NO: 452) is shown in bold; this coding portion starts at position 507 and ends at position 1115. The transcript also has the following SNPs as listed in Table 9 (given according to their position on the nucleotide sequence, with the alternative nucleic acid listed; the last column indicates whether the SNP is known or not; the presence of known SNPs in variant protein HSMUC1A_PEA_1_P25 (SEQ ID NO: 488) sequence provides support for the deduced sequence of this variant protein according to the present invention).

TABLE 9

Nucleic acid SNPs

| SNP position on nucleotide sequence | Alternative nucleic acid | Previously known SNP? |
|---|---|---|
| 572 | A −> G | No |
| 775 | G −> A | Yes |
| 777 | G −> A | No |
| 977 | C −> | No |
| 1065 | A −> G | No |
| 1073 | C −> T | No |
| 1079 | C −> T | Yes |
| 1124 | C −> T | Yes |
| 1177 | C −> T | No |
| 1197 | C −> T | Yes |
| 1303 | G −> | No |
| 1315 | G −> A | Yes |
| 1316 | C −> | No |
| 1316 | C −> T | No |
| 1405 | A −> T | No |

Variant protein HSMUC1A_PEA_1_P29 (SEQ ID NO: 489) according to the present invention has an amino acid sequence as given at the end of the application; it is encoded by transcript(s) HSMUC1A_PEA_1_T33 (SEQ ID NO: 457). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P29 (SEQ ID NO: 489) is encoded by the following transcript(s): HSMUC1A_PEA_1_T33 (SEQ ID NO: 457), for which the sequence(s) is/are given at the end of the application. The coding portion of transcript HSMUC1A_PEA_1_T33 (SEQ ID NO: 457) is shown in bold; this coding portion starts at position 507 and ends at position 953. The transcript also has the following SNPs as listed in Table 10 (given according to their position on the nucleotide sequence, with the alternative nucleic acid listed; the last column indicates whether the SNP is known or not; the presence of known SNPs in variant protein HSMUC1A_PEA_1_P29 (SEQ ID NO: 489) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 572 | A -> G | No |
| 964 | C-> | No |
| 1052 | A -> G | No |
| 1060 | C -> T | No |
| 1066 | C -> T | Yes |
| 1111 | C -> T | Yes |
| 1164 | C -> T | No |
| 1184 | C -> T | Yes |
| 1290 | G-> | No |
| 1302 | G -> A | Yes |
| 1303 | C-> | No |
| 1303 | C -> T | No |
| 1392 | A -> T | No |

Variant protein HSMUC1A_PEA_1_P30 (SEQ ID NO: 490) according to the present invention has an amino acid sequence as given at the end of the application; it is encoded by transcript(s) HSMUC1A_PEA_1_T34 (SEQ ID NO: 458). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide.

Variant protein HSMUC1A_PEA_1_P30 (SEQ ID NO: 490) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein HSMUC1A_PEA_1_P30 (SEQ ID NO: 490) sequence provides support for the deduced sequence of this variant protein according to the present invention).

TABLE 11

Amino acid mutations

| SNP position(s) on amino acid sequence | Alternative amino acid(s) | Previously known SNP? |
|---|---|---|
| 120 | Y-> | No |
| 150 | S -> G | No |

Variant protein HSMUC1A_PEA_1_P30 (SEQ ID NO: 490) is encoded by the following transcript(s): HSMUC1A_PEA_1_T34 (SEQ ID NO: 458), for which the sequence(s) is/are given at the end of the application. The coding portion of transcript HSMUC1A_PEA_1_T34 (SEQ ID NO: 458) is shown in bold; this coding portion starts at position 507 and ends at position 1004. The transcript also has the following SNPs as listed in Table 12 (given according to their position on the nucleotide sequence, with the alternative nucleic acid listed; the last column indicates whether the SNP is known or not; the presence of known SNPs in variant protein HSMUC1A_PEA_1_P30 (SEQ ID NO: 490) sequence provides support for the deduced sequence of this variant protein according to the present invention).

TABLE 12

Nucleic acid SNPs

| SNP position on nucleotide sequence | Alternative nucleic acid | Previously known SNP? |
|---|---|---|
| 599 | A -> G | No |
| 866 | C-> | No |
| 954 | A -> G | No |
| 962 | C -> T | No |
| 968 | C -> T | Yes |
| 1013 | C -> T | Yes |
| 1066 | C -> T | No |
| 1086 | C -> T | Yes |
| 1192 | G-> | No |
| 1204 | G -> A | Yes |
| 1205 | C-> | No |
| 1205 | C -> T | No |
| 1294 | A -> T | No |

Variant protein HSMUC1A_PEA_1_P32 (SEQ ID NO: 491) according to the present invention has an amino acid sequence as given at the end of the application; it is encoded by transcript(s) HSMUC1A_PEA_1_T36 (SEQ ID NO: 460). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide.

Variant protein HSMUC1A_PEA_1_P32 (SEQ ID NO: 491) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein HSMUC1A_PEA_1_P32 (SEQ ID NO: 491) sequence provides support for the deduced sequence of this variant protein according to the present invention).

TABLE 13

Amino acid mutations

| SNP position(s) on amino acid sequence | Alternative amino acid(s) | Previously known SNP? |
|---|---|---|
| 111 | Y-> | No |
| 141 | S -> G | No |

Variant protein HSMUC1A_PEA_1_P32 (SEQ ID NO: 491) is encoded by the following transcript(s): HSMUC1A_PEA_1_T36 (SEQ ID NO: 460), for which the sequence(s) is/are given at the end of the application. The coding portion of transcript HSMUC1A_PEA_1_T36 (SEQ ID NO: 460) is shown in bold; this coding portion starts at position 507 and ends at position 977. The transcript also has the following SNPs as listed in Table 14 (given according to their position on the nucleotide sequence, with the alternative nucleic acid listed; the last column indicates whether the SNP is known or not; the presence of known SNPs in variant protein HSMUC1A_PEA_1_P32 (SEQ ID NO: 491) sequence provides support for the deduced sequence of this variant protein according to the present invention).

TABLE 14

Nucleic acid SNPs

| SNP position on nucleotide sequence | Alternative nucleic acid | Previously known SNP? |
|---|---|---|
| 572 | A -> G | No |
| 839 | C -> | No |
| 927 | A -> G | No |
| 935 | C -> T | No |
| 941 | C -> T | Yes |
| 986 | C -> T | Yes |
| 1039 | C -> T | No |
| 1059 | C -> T | Yes |
| 1165 | G-> | No |
| 1177 | G -> A | Yes |
| 1178 | C-> | No |
| 1178 | C -> T | No |
| 1267 | A -> T | No |

Variant protein HSMUC1A_PEA_1_P36 (SEQ ID NO: 492) according to the present invention has an amino acid sequence as given at the end of the application; it is encoded by transcript(s) HSMUC1A_PEA_1_T40 (SEQ ID NO: 461). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P36 (SEQ ID NO: 492) also has the following non-silent SNPs (Single Nucleotide Polymorphisms) as listed in Table 15, (given according to their position(s) on the amino acid sequence, with the alternative amino acid(s) listed; the last column indicates whether the SNP is known or not; the presence of known SNPs in variant protein HSMUC1A_PEA_1_P36 (SEQ ID NO: 492) sequence provides support for the deduced sequence of this variant protein according to the present invention).

TABLE 15

Amino acid mutations

| SNP position(s) on amino acid sequence | Alternative amino acid(s) | Previously known SNP? |
|---|---|---|
| 113 | Y-> | No |
| 143 | S -> G | No |

Variant protein HSMUC1A_PEA_1_P36 (SEQ ID NO: 492) is encoded by the following transcript(s): HSMUC1A_PEA_1_T40 (SEQ ID NO: 461), for which the sequence(s) is/are given at the end of the application. The coding portion of transcript HSMUC1A_PEA_1_T40 (SEQ ID NO: 461) is shown in bold; this coding portion starts at position 507 and ends at position 983. The transcript also has the following SNPs as listed in Table 16 (given according to their position on the nucleotide sequence, with the alternative nucleic acid listed; the last column indicates whether the SNP is known or not; the presence of known SNPs in variant protein HSMUC1A_PEA_1_P36 (SEQ ID NO: 492) sequence provides support for the deduced sequence of this variant protein according to the present invention).

TABLE 16

Nucleic acid SNPs

| SNP position on nucleotide sequence | Alternative nucleic acid | Previously known SNP? |
|---|---|---|
| 599 | A -> G | No |
| 845 | C -> | No |
| 933 | A -> G | No |
| 941 | C -> T | No |
| 947 | C -> T | Yes |
| 992 | C -> T | Yes |
| 1045 | C -> T | No |
| 1065 | C -> T | Yes |
| 1171 | G-> | No |
| 1183 | G -> A | Yes |
| 1184 | C-> | No |
| 1184 | C -> T | No |
| 1273 | A -> T | No |

Variant protein HSMUC1A_PEA_1_P39 (SEQ ID NO: 493) according to the present invention has an amino acid sequence as given at the end of the application; it is encoded by transcript(s) HSMUC1A_PEA_1_T43 (SEQ ID NO: 463). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P39 (SEQ ID NO: 493) also has the following non-silent SNPs (Single Nucleotide Polymorphisms) as listed in Table 17, (given according to their position(s) on the amino acid sequence, with the alternative amino acid(s) listed; the last column indicates whether the SNP is known or not; the presence of known SNPs in variant protein HSMUC1A_PEA_1_P39 (SEQ ID NO: 493) sequence provides support for the deduced sequence of this variant protein according to the present invention).

TABLE 17

Amino acid mutations

| SNP position(s) on amino acid sequence | Alternative amino acid(s) | Previously known SNP? |
|---|---|---|
| 90 | Y-> | No |
| 120 | S -> G | No |

Variant protein HSMUC1A_PEA_1_P39 (SEQ ID NO: 493) is encoded by the following transcript(s): HSMUC1A_PEA_1_T43 (SEQ ID NO: 463), for which the sequence(s) is/are given at the end of the application. The coding portion of transcript HSMUC1A_PEA_1_T43 (SEQ ID NO: 463) is shown in bold; this coding portion starts at position 507 and ends at position 914. The transcript also has the following SNPs as listed in Table 18 (given according to their position on the nucleotide sequence, with the alternative nucleic acid listed; the last column indicates whether the SNP is known or not; the presence of known SNPs in variant protein HSMUC1A_PEA_1_P39 (SEQ ID NO: 493) sequence provides support for the deduced sequence of this variant protein according to the present invention).

TABLE 18

Nucleic acid SNPs

| SNP position on nucleotide sequence | Alternative nucleic acid | Previously known SNP? |
|---|---|---|
| 599 | A -> G | No |
| 776 | C -> | No |
| 864 | A -> G | No |
| 872 | C -> T | No |
| 878 | C -> T | Yes |
| 923 | C -> T | Yes |
| 976 | C -> T | No |
| 996 | C -> T | Yes |
| 1102 | G -> | No |
| 1114 | G -> A | Yes |
| 1115 | C -> | No |
| 1115 | C -> T | No |
| 1204 | A -> T | No |

Variant protein HSMUC1A_PEA_1_P45 (SEQ ID NO: 494) according to the present invention has an amino acid sequence as given at the end of the application; it is encoded by transcript(s) HSMUC1A_PEA_1_T29 (SEQ ID NO: 454). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P45 (SEQ ID NO: 494) is encoded by the following transcript(s): HSMUC1A_PEA_1_T29 (SEQ ID NO: 454), for which the sequence(s) is/are given at the end of the application. The coding portion of transcript HSMUC1A_PEA_1_T29 (SEQ ID NO: 454) is shown in bold; this coding portion starts at position 507 and ends at position 746. The transcript also has the following SNPs as listed in Table 19 (given according to their position on the nucleotide sequence, with the alternative nucleic acid listed; the last column indicates whether the SNP is known or not; the presence of known SNPs in variant protein HSMUC1A_PEA_1_P45 (SEQ ID NO: 494) sequence provides support for the deduced sequence of this variant protein according to the present invention).

TABLE 19

Nucleic acid SNPs

| SNP position on nucleotide sequence | Alternative nucleic acid | Previously known SNP? |
|---|---|---|
| 599 | A -> G | No |
| 746 | G -> A | Yes |
| 748 | G -> A | No |
| 948 | C -> | No |
| 1036 | A -> G | No |
| 1044 | C -> T | No |
| 1050 | C -> T | Yes |
| 1095 | C -> T | Yes |
| 1148 | C -> T | No |
| 1168 | C -> T | Yes |
| 1274 | G -> | No |
| 1286 | G -> A | Yes |

TABLE 19-continued

Nucleic acid SNPs

| SNP position on nucleotide sequence | Alternative nucleic acid | Previously known SNP? |
|---|---|---|
| 1287 | C -> | No |
| 1287 | C -> T | No |
| 1376 | A -> T | No |

Variant protein HSMUC1A_PEA_1_P49 (SEQ ID NO: 495) according to the present invention has an amino acid sequence as given at the end of the application; it is encoded by transcript(s) HSMUC1A_PEA_1_T12 (SEQ ID NO: 451). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P49 (SEQ ID NO: 495) is encoded by the following transcript(s): HSMUC1A_PEA_1_T12 (SEQ ID NO: 451), for which the sequence(s) is/are given at the end of the application. The coding portion of transcript HSMUC1A_PEA_1_T12 (SEQ ID NO: 451) is shown in bold; this coding portion starts at position 507 and ends at position 884. The transcript also has the following SNPs as listed in Table 20 (given according to their position on the nucleotide sequence, with the alternative nucleic acid listed; the last column indicates whether the SNP is known or not; the presence of known SNPs in variant protein HSMUC1A_PEA_1_P49 (SEQ ID NO: 495) sequence provides support for the deduced sequence of this variant protein according to the present invention).

TABLE 20

Nucleic acid SNPs

| SNP position on nucleotide sequence | Alternative nucleic acid | Previously known SNP? |
|---|---|---|
| 572 | A -> G | No |
| 704 | G -> A | Yes |
| 1012 | G -> A | Yes |
| 1088 | G -> A | Yes |
| 1090 | G -> A | No |
| 1290 | C -> | No |
| 1378 | A -> G | No |
| 1386 | C -> T | No |
| 1392 | C -> T | Yes |
| 1437 | C -> T | Yes |
| 1490 | C -> T | No |
| 1510 | C -> T | Yes |
| 1616 | G -> | No |
| 1628 | G -> A | Yes |
| 1629 | C -> | No |
| 1629 | C -> T | No |
| 1718 | A -> T | No |

Variant protein HSMUC1A_PEA_1_P52 (SEQ ID NO: 496) according to the present invention has an amino acid sequence as given at the end of the application; it is encoded by transcript(s) HSMUC1A_PEA_1_T30 (SEQ ID NO: 455). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P52 (SEQ ID NO: 496) is encoded by the following transcript(s): HSMUC1A_PEA_1_T30 (SEQ ID NO: 455), for which the sequence(s) is/are given at the end of the application. The coding portion of transcript HSMUC1A_PEA_1_T30 (SEQ ID NO: 455) is shown in bold; this coding portion starts at position 507 and ends at position 719. The transcript also has the following SNPs as listed in Table 21 (given according to their position on the nucleotide sequence, with the alternative nucleic acid listed; the last column indicates whether the SNP is known or not; the presence of known SNPs in variant protein HSMUC1A_PEA_1_P52 (SEQ ID NO: 496) sequence provides support for the deduced sequence of this variant protein according to the present invention).

TABLE 21

Nucleic acid SNPs

| SNP position on nucleotide sequence | Alternative nucleic acid | Previously known SNP? |
|---|---|---|
| 572 | A -> G | No |
| 719 | G -> A | Yes |
| 721 | G -> A | No |
| 921 | C-> | No |
| 1009 | A -> G | No |
| 1017 | C -> T | No |
| 1023 | C -> T | Yes |
| 1068 | C -> T | Yes |
| 1121 | C -> T | No |
| 1141 | C -> T | Yes |
| 1247 | G-> | No |
| 1259 | G -> A | Yes |
| 1260 | C-> | No |
| 1260 | C -> T | No |
| 1349 | A -> T | No |

Variant protein HSMUC1A_PEA_1_P53 (SEQ ID NO: 497) according to the present invention has an amino acid sequence as given at the end of the application; it is encoded by transcript(s) HSMUC1A_PEA_1_T31 (SEQ ID NO: 456). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P53 (SEQ ID NO: 497) is encoded by the following transcript(s): HSMUC1A_PEA_1_T31 (SEQ ID NO: 456), for which the sequence(s) is/are given at the end of the application. The coding portion of transcript HSMUC1A_PEA_1_T31 (SEQ ID NO: 456) is shown in bold; this coding portion starts at position 507 and ends at position 665. The transcript also has the following SNPs as listed in Table 22 (given according to their position on the nucleotide sequence, with the alternative nucleic acid listed; the last column indicates whether the SNP is known or not; the presence of known SNPs in variant protein HSMUC1A_PEA_1_P53 (SEQ ID NO: 497) sequence provides support for the deduced sequence of this variant protein according to the present invention).

TABLE 22

Nucleic acid SNPs

| SNP position on nucleotide sequence | Alternative nucleic acid | Previously known SNP? |
|---|---|---|
| 572 | A -> G | No |
| 669 | G -> A | Yes |
| 671 | G -> A | No |
| 871 | C-> | No |
| 959 | A -> G | No |
| 967 | C -> T | No |
| 973 | C -> T | Yes |
| 1018 | C -> T | Yes |
| 1071 | C -> T | No |
| 1091 | C -> T | Yes |
| 1197 | G-> | No |
| 1209 | G -> A | Yes |
| 1210 | C-> | No |
| 1210 | C -> T | No |
| 1299 | A -> T | No |

Variant protein HSMUC1A_PEA_1_P56 (SEQ ID NO: 498) according to the present invention has an amino acid sequence as given at the end of the application; it is encoded by transcript(s) HSMUC1A_PEA_1_T42 (SEQ ID NO: 462). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P56 (SEQ ID NO: 498) also has the following non-silent SNPs (Single Nucleotide Polymorphisms) as listed in Table 23, (given according to their position(s) on the amino acid sequence, with the alternative amino acid(s) listed; the last column indicates whether the SNP is known or not; the presence of known SNPs in variant protein HSMUC1A_PEA_1_P56 (SEQ ID NO: 498) sequence provides support for the deduced sequence of this variant protein according to the present invention).

TABLE 23

Amino acid mutations

| SNP position(s) on amino acid sequence | Alternative amino acid(s) | Previously known SNP? |
|---|---|---|
| 117 | P -> | No |

Variant protein HSMUC1A_PEA_1_P56 (SEQ ID NO: 498) is encoded by the following transcript(s): HSMUC1A_PEA_1_T42 (SEQ ID NO: 462), for which the sequence(s) is/are given at the end of the application. The coding portion of transcript HSMUC1A_PEA_1_T42 (SEQ ID NO: 462) is shown in bold; this coding portion starts at position 507 and ends at position 890. The transcript also has the following SNPs as listed in Table 24 (given according to their position on the nucleotide sequence, with the alternative nucleic acid listed; the last column indicates whether the SNP is known or not; the presence of known SNPs in variant protein HSMUC1A_PEA_1_P56 (SEQ ID NO: 498) sequence provides support for the deduced sequence of this variant protein according to the present invention).

TABLE 24

Nucleic acid SNPs

| SNP position on nucleotide sequence | Alternative nucleic acid | Previously known SNP? |
|---|---|---|
| 572 | A -> G | No |
| 855 | C -> | No |
| 943 | A -> G | No |
| 951 | C -> T | No |
| 957 | C -> T | Yes |
| 1002 | C -> T | Yes |
| 1055 | C -> T | No |
| 1075 | C -> T | Yes |
| 1181 | G -> | No |
| 1193 | G -> A | Yes |
| 1194 | C -> | No |
| 1194 | C -> T | No |
| 1283 | A -> T | No |

Variant protein HSMUC1A_PEA_1_P58 (SEQ ID NO: 499) according to the present invention has an amino acid sequence as given at the end of the application; it is encoded by transcript(s) HSMUC1A_PEA_1_T35 (SEQ ID NO: 459). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P58 (SEQ ID NO: 499) also has the following non-silent SNPs (Single Nucleotide Polymorphisms) as listed in Table 25, (given according to their position(s) on the amino acid sequence, with the alternative amino acid(s) listed; the last column indicates whether the SNP is known or not; the presence of known SNPs in variant protein HSMUC1A_PEA_1_P58 (SEQ ID NO: 499) sequence provides support for the deduced sequence of this variant protein according to the present invention).

TABLE 25

Amino acid mutations

| SNP position(s) on amino acid sequence | Alternative amino acid(s) | Previously known SNP? |
|---|---|---|
| 147 | P -> | No |

Variant protein HSMUC1A_PEA_1_P58 (SEQ ID NO: 499) is encoded by the following transcript(s): HSMUC1A_PEA_1_T35 (SEQ ID NO: 459), for which the sequence(s) is/are given at the end of the application. The coding portion of transcript HSMUC1A_PEA_1_T35 (SEQ ID NO: 459) is shown in bold; this coding portion starts at position 507 and ends at position 980. The transcript also has the following SNPs as listed in Table 26 (given according to their position on the nucleotide sequence, with the alternative nucleic acid listed; the last column indicates whether the SNP is known or not; the presence of known SNPs in variant protein HSMUC1A_PEA_1_P58 (SEQ ID NO: 499) sequence provides support for the deduced sequence of this variant protein according to the present invention).

TABLE 26

Nucleic acid SNPs

| SNP position on nucleotide sequence | Alternative nucleic acid | Previously known SNP? |
|---|---|---|
| 572 | A -> G | No |
| 945 | C -> | No |
| 1033 | A -> G | No |
| 1041 | C -> T | No |
| 1047 | C -> T | Yes |
| 1092 | C -> T | Yes |
| 1145 | C -> T | No |
| 1165 | C -> T | Yes |
| 1271 | G -> | No |
| 1283 | G -> A | Yes |
| 1284 | C -> | No |
| 1284 | C -> T | No |
| 1373 | A -> T | No |

Variant protein HSMUC1A_PEA_1_P59 (SEQ ID NO: 500) according to the present invention has an amino acid sequence as given at the end of the application; it is encoded by transcript(s) HSMUC1A_PEA_1_T28 (SEQ ID NO: 453). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P59 (SEQ ID NO: 500) is encoded by the following transcript(s): HSMUC1A_PEA_1_T28 (SEQ ID NO: 453), for which the sequence(s) is/are given at the end of the application. The coding portion of transcript HSMUC1A_PEA_1_T28 (SEQ ID NO: 453) is shown in bold; this coding portion starts at position 507 and ends at position 794. The transcript also has the following SNPs as listed in Table 27 (given according to their position on the nucleotide sequence, with the alternative nucleic acid listed; the last column indicates whether the SNP is known or not; the presence of known SNPs in variant protein HSMUC1A_PEA_1_P59 (SEQ ID NO: 500) sequence provides support for the deduced sequence of this variant protein according to the present invention).

TABLE 27

Nucleic acid SNPs

| SNP position on nucleotide sequence | Alternative nucleic acid | Previously known SNP? |
|---|---|---|
| 572 | A -> G | No |
| 794 | G -> A | Yes |
| 796 | G -> A | No |
| 996 | C -> | No |
| 1084 | A -> G | No |
| 1092 | C -> T | No |
| 1098 | C -> T | Yes |
| 1143 | C -> T | Yes |
| 1196 | C -> T | No |
| 1216 | C -> T | Yes |

TABLE 27-continued

Nucleic acid SNPs

| SNP position on nucleotide sequence | Alternative nucleic acid | Previously known SNP? |
|---|---|---|
| 1322 | G -> | No |
| 1334 | G -> A | Yes |
| 1335 | C -> | No |
| 1335 | C -> T | No |
| 1424 | A -> T | No |

Variant protein HSMUC1A_PEA_1_P63 (SEQ ID NO: 501) according to the present invention has an amino acid sequence as given at the end of the application; it is encoded by transcript(s) HSMUC1A_PEA_1_T47 (SEQ ID NO: 464). An alignment is given to the known protein (Mucin 1 precursor) at the end of the application. One or more alignments to one or more previously published protein sequences are given at the end of the application. A brief description of the relationship of the variant protein according to the present invention to each such aligned protein is as follows:

Comparison report between HSMUC1A_PEA_1_P63 (SEQ ID NO: 501) and MUC1_HUMAN:

1. An isolated chimeric polypeptide encoding for HSMUC1A_PEA_1_P63 (SEQ ID NO: 501), comprising a first amino acid sequence being at least 90% homologous to MTPGTQSPFFLLLLLTVLTVVTGSGHAS-STPGGEKETSATQRSSV corresponding to amino acids 1-45 of MUC1_HUMAN, which also corresponds to amino acids 1-45 of HSMUC1A_PEA_1_P63 (SEQ ID NO: 501), and a second amino acid sequence being at least 70%, optionally at least 80%, preferably at least 85%, more preferably at least 90% and most preferably at least 95% homologous to a polypeptide having the sequence EEEVSADQVSVGASGV-LGSFKEARNAPSFLSWSFSMGPSK (SEQ ID NO: 1060) corresponding to amino acids 46-85 of HSMUC1A_PEA_1_P63 (SEQ ID NO: 501), wherein said first amino acid sequence and second amino acid sequence are contiguous and in a sequential order.

2. An isolated polypeptide encoding for a tail of HSMUC1A_PEA_1_P63 (SEQ ID NO: 501), comprising a polypeptide being at least 70%, optionally at least about 80%, preferably at least about 85%, more preferably at least about 90% and most preferably at least about 95% homologous to the sequence EEEVSADQVSVGASGVLGSFKEARNAPS-FLSWSFSMGPSK (SEQ ID NO: 1060) in HSMUC1A_PEA_1_P63 (SEQ ID NO: 501).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

The glycosylation sites of variant protein HSMUC1A_PEA_1_P63 (SEQ ID NO: 501), as compared to the known protein Mucin 1 precursor, are described in Table 28 (given according to their position(s) on the amino acid sequence in the first column; the second column indicates whether the glycosylation site is present in the variant protein; and the last column indicates whether the position is different on the variant protein).

TABLE 28

Glycosylation site(s)

| Position(s) on known amino acid sequence | Present in variant protein? | Position in variant protein? |
|---|---|---|
| 1055 | no | |
| 957 | no | |
| 975 | no | |
| 1133 | no | |
| 1029 | no | |

Variant protein HSMUC1A_PEA_1_P63 (SEQ ID NO: 501) is encoded by the following transcript(s): HSMUC1A_PEA_1_T47 (SEQ ID NO: 464), for which the sequence(s) is/are given at the end of the application. The coding portion of transcript HSMUC1A_PEA_1_T47 (SEQ ID NO: 464) is shown in bold; this coding portion starts at position 507 and ends at position 761. The transcript also has the following SNPs as listed in Table 29 (given according to their position on the nucleotide sequence, with the alternative nucleic acid listed; the last column indicates whether the SNP is known or not; the presence of known SNPs in variant protein HSMUC1A_PEA_1_P63 (SEQ ID NO: 501) sequence provides support for the deduced sequence of this variant protein according to the present invention).

TABLE 29

Nucleic acid SNPs

| SNP position on nucleotide sequence | Alternative nucleic acid | Previously known SNP? |
|---|---|---|
| 572 | A -> G | No |
| 900 | A -> | No |
| 904 | C -> | No |
| 963 | A -> C | Yes |
| 1211 | A -> G | No |
| 1219 | C -> T | No |
| 1225 | C -> T | Yes |
| 1270 | C -> T | Yes |
| 1323 | C -> T | No |
| 1343 | C -> T | Yes |
| 1449 | G -> | No |
| 1461 | G -> A | Yes |
| 1462 | C -> | No |
| 1462 | C -> T | No |
| 1551 | A -> T | No |

As noted above, cluster HSMUC1A features 22 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSMUC1A_PEA_1_node_0 (SEQ ID NO: 465) according to the present invention is supported by 31 libraries. The number of libraries was determined as previously described. This segment can be found in the following transcript(s): HSMUC1A_PEA_1_T12 (SEQ ID NO: 451), HSMUC1A_PEA_1_T26 (SEQ ID NO: 452), HSMUC1A_PEA_1_T28 (SEQ ID NO: 453), HSMUC1A_PEA_1_T29 (SEQ ID NO: 454), HSMUC1A_PEA_1_T30 (SEQ ID NO: 455), HSMUC1A_PEA_1_T31 (SEQ ID NO: 456), HSMUC1A_PEA_1_T33 (SEQ ID NO: 457), HSMUC1A_PEA_1_T34 (SEQ ID NO: 458), HSMUC1A_PEA_1_T35 (SEQ ID NO: 459), HSMUC1A_PEA_1_T36 (SEQ ID NO: 460), HSMUC1A_PEA_1_T40 (SEQ ID NO: 461), HSMUC1A_PEA_1_T42 (SEQ ID NO: 462), HSMUC1A_PEA_1_T43 (SEQ ID NO: 463) and HSMUC1A_PEA_1_T47 (SEQ ID NO: 464). Table 30 below describes the starting and ending position of this segment on each transcript.

TABLE 30

Segment location on transcripts

| Transcript name | Segment starting position | Segment ending position |
|---|---|---|
| HSMUC1A_PEA_1_T12 (SEQ ID NO: 451) | 1 | 564 |
| HSMUC1A_PEA_1_T26 (SEQ ID NO: 452) | 1 | 564 |
| HSMUC1A_PEA_1_T28 (SEQ ID NO: 453) | 1 | 564 |
| HSMUC1A_PEA_1_T29 (SEQ ID NO: 454) | 1 | 564 |
| HSMUC1A_PEA_1_T30 (SEQ ID NO: 455) | 1 | 564 |
| HSMUC1A_PEA_1_T31 (SEQ ID NO: 456) | 1 | 564 |
| HSMUC1A_PEA_1_T33 (SEQ ID NO: 457) | 1 | 564 |
| HSMUC1A_PEA_1_T34 (SEQ ID NO: 458) | 1 | 564 |
| HSMUC1A_PEA_1_T35 (SEQ ID NO: 459) | 1 | 564 |
| HSMUC1A_PEA_1_T36 (SEQ ID NO: 460) | 1 | 564 |
| HSMUC1A_PEA_1_T40 (SEQ ID NO: 461) | 1 | 564 |
| HSMUC1A_PEA_1_T42 (SEQ ID NO: 462) | 1 | 564 |
| HSMUC1A_PEA_1_T43 (SEQ ID NO: 463) | 1 | 564 |
| HSMUC1A_PEA_1_T47 (SEQ ID NO: 464) | 1 | 564 |

Segment cluster HSMUC1A_PEA_1_node_14 (SEQ ID NO: 466) according to the present invention is supported by 55 libraries. The number of libraries was determined as previously described. This segment can be found in the following transcript(s): HSMUC1A_PEA_1_T12 (SEQ ID NO: 451). Table 31 below describes the starting and ending position of this segment on each transcript.

TABLE 31

Segment location on transcripts

| Transcript name | Segment starting position | Segment ending position |
|---|---|---|
| HSMUC1A_PEA_1_T12 (SEQ ID NO: 451) | 666 | 841 |

Segment cluster HSMUC1A_PEA_1_node_24 (SEQ ID NO: 467) according to the present invention is supported by 135 libraries. The number of libraries was determined as previously described. This segment can be found in the following transcript(s): HSMUC1A_PEA_1_T12 (SEQ ID NO: 451). Table 32 below describes the starting and ending position of this segment on each transcript.

TABLE 32

Segment location on transcripts

| Transcript name | Segment starting position | Segment ending position |
|---|---|---|
| HSMUC1A_PEA_1_T12 (SEQ ID NO: 451) | 953 | 1084 |

Segment cluster HSMUC1A_PEA_1_node_29 (SEQ ID NO: 468) according to the present invention is supported by 156 libraries. The number of libraries was determined as previously described. This segment can be found in the following transcript(s): HSMUC1A_PEA_1_T12 (SEQ ID NO: 451), HSMUC1A_PEA_1_T26 (SEQ ID NO: 452), HSMUC1A_PEA_1_T28 (SEQ ID NO: 453), HSMUC1A_PEA_1_T29 (SEQ ID NO: 454), HSMUC1A_PEA_1_T30 (SEQ ID NO: 455), HSMUC1A_PEA_1_T31 (SEQ ID NO: 456), HSMUC1A_PEA_1_T33 (SEQ ID NO: 457), HSMUC1A_PEA_1_T34 (SEQ ID NO: 458), HSMUC1A_PEA_1_T35 (SEQ ID NO: 459), HSMUC1A_PEA_1_T36 (SEQ ID NO: 460), HSMUC1A_PEA_1_T40 (SEQ ID NO: 461), HSMUC1A_PEA_1_T42 (SEQ ID NO: 462) and HSMUC1A_PEA_1_T43 (SEQ ID NO: 463). Table 33 below describes the starting and ending position of this segment on each transcript.

TABLE 33

Segment location on transcripts

| Transcript name | Segment starting position | Segment ending position |
|---|---|---|
| HSMUC1A_PEA_1_T12 (SEQ ID NO: 451) | 1207 | 1346 |
| HSMUC1A_PEA_1_T26 (SEQ ID NO: 452) | 894 | 1033 |
| HSMUC1A_PEA_1_T28 (SEQ ID NO: 453) | 913 | 1052 |
| HSMUC1A_PEA_1_T29 (SEQ ID NO: 454) | 865 | 1004 |
| HSMUC1A_PEA_1_T30 (SEQ ID NO: 455) | 838 | 977 |
| HSMUC1A_PEA_1_T31 (SEQ ID NO: 456) | 788 | 927 |
| HSMUC1A_PEA_1_T33 (SEQ ID NO: 457) | 881 | 1020 |
| HSMUC1A_PEA_1_T34 (SEQ ID NO: 458) | 783 | 922 |
| HSMUC1A_PEA_1_T35 (SEQ ID NO: 459) | 862 | 1001 |
| HSMUC1A_PEA_1_T36 (SEQ ID NO: 460) | 756 | 895 |
| HSMUC1A_PEA_1_T40 (SEQ ID NO: 461) | 762 | 901 |
| HSMUC1A_PEA_1_T42 (SEQ ID NO: 462) | 772 | 911 |
| HSMUC1A_PEA_1_T43 (SEQ ID NO: 463) | 693 | 832 |

Segment cluster HSMUC1A_PEA_1_node_35 (SEQ ID NO: 469) according to the present invention is supported by 51 libraries. The number of libraries was determined as previously described. This segment can be found in the following transcript(s): HSMUC1A_PEA_1_T47 (SEQ ID NO: 464). Table 34 below describes the starting and ending position of this segment on each transcript.

TABLE 34

Segment location on transcripts

| Transcript name | Segment starting position | Segment ending position |
|---|---|---|
| HSMUC1A_PEA_1_T47 (SEQ ID NO: 464) | 666 | 1189 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in regard to ovarian cancer), shown in Table 35.

TABLE 35

Oligonucleotides related to this segment

| Oligonucleotide name | Overexpressed in cancers | Chip reference |
|---|---|---|
| HSMUC1A_0_0_11365 (SEQ ID NO: 1030) | ovarian carcinoma | OVA |

Segment cluster HSMUC1A_PEA_1_node_38 (SEQ ID NO: 470) according to the present invention is supported by 140 libraries. The number of libraries was determined as previously described. This segment can be found in the following transcript(s): HSMUC1A_PEA_1_T12 (SEQ ID NO: 451), HSMUC1A_PEA_1_T26 (SEQ ID NO: 452), HSMUC1A_PEA_1_T28 (SEQ ID NO: 453), HSMUC1A_PEA_1_T29 (SEQ ID NO: 454), HSMUC1A_PEA_1_T30 (SEQ ID NO: 455), HSMUC1A_PEA_1_T31 (SEQ ID NO: 456), HSMUC1A_PEA_1_T33 (SEQ ID NO: 457), HSMUC1A_PEA_1_T34 (SEQ ID NO: 458), HSMUC1A_PEA_1_T35 (SEQ ID NO: 459), HSMUC1A_PEA_1_T36 (SEQ ID NO: 460), HSMUC1A_PEA_1_T40 (SEQ ID NO: 461), HSMUC1A_PEA_1_T42 (SEQ ID NO: 462), HSMUC1A_PEA_1_T43 (SEQ ID NO: 463) and HSMUC1A_PEA_1_T47 (SEQ ID NO: 464). Table 36 below describes the starting and ending position of this segment on each transcript.

TABLE 36

Segment location on transcripts

| Transcript name | Segment starting position | Segment ending position |
|---|---|---|
| HSMUC1A_PEA_1_T12 (SEQ ID NO: 451) | 1488 | 1749 |
| HSMUC1A_PEA_1_T26 (SEQ ID NO: 452) | 1175 | 1436 |
| HSMUC1A_PEA_1_T28 (SEQ ID NO: 453) | 1194 | 1455 |
| HSMUC1A_PEA_1_T29 (SEQ ID NO: 454) | 1146 | 1407 |
| HSMUC1A_PEA_1_T30 (SEQ ID NO: 455) | 1119 | 1380 |
| HSMUC1A_PEA_1_T31 (SEQ ID NO: 456) | 1069 | 1330 |
| HSMUC1A_PEA_1_T33 (SEQ ID NO: 457) | 1162 | 1423 |
| HSMUC1A_PEA_1_T34 (SEQ ID NO: 458) | 1064 | 1325 |
| HSMUC1A_PEA_1_T35 (SEQ ID NO: 459) | 1143 | 1404 |
| HSMUC1A_PEA_1_T36 (SEQ ID NO: 460) | 1037 | 1298 |
| HSMUC1A_PEA_1_T40 (SEQ ID NO: 461) | 1043 | 1304 |
| HSMUC1A_PEA_1_T42 (SEQ ID NO: 462) | 1053 | 1314 |
| HSMUC1A_PEA_1_T43 (SEQ ID NO: 463) | 974 | 1235 |
| HSMUC1A_PEA_1_T47 (SEQ ID NO: 464) | 1321 | 1582 |

According to an optional embodiment of the present invention, short segments related to the above cluster are also provided. These segments are up to about 120 bp in length, and so are included in a separate description.

Segment cluster HSMUC1A_PEA_1_node_3 (SEQ ID NO: 471) according to the present invention is supported by 17 libraries. The number of libraries was determined as previously described. This segment can be found in the following transcript(s): HSMUC1A_PEA_1_T29 (SEQ ID NO: 454), HSMUC1A_PEA_1_T34 (SEQ ID NO: 458), HSMUC1A_PEA_1_T40 (SEQ ID NO: 461) and HSMUC1A_PEA_1_T43 (SEQ ID NO: 463). Table 37 below describes the starting and ending position of this segment on each transcript.

TABLE 37

Segment location on transcripts

| Transcript name | Segment starting position | Segment ending position |
|---|---|---|
| HSMUC1A_PEA_1_T29 (SEQ ID NO: 454) | 565 | 591 |
| HSMUC1A_PEA_1_T34 (SEQ ID NO: 458) | 565 | 591 |
| HSMUC1A_PEA_1_T40 (SEQ ID NO: 461) | 565 | 591 |
| HSMUC1A_PEA_1_T43 (SEQ ID NO: 463) | 565 | 591 |

Segment cluster HSMUC1A_PEA_1_node_4 (SEQ ID NO: 472) according to the present invention can be found in the following transcript(s): HSMUC1A_PEA_1_T12 (SEQ ID NO: 451), HSMUC1A_PEA_1_T26 (SEQ ID NO: 452), HSMUC1A_PEA_1_T28 (SEQ ID NO: 453), HSMUC1A_PEA_1_T29 (SEQ ID NO: 454), HSMUC1A_PEA_1_T30 (SEQ ID NO: 455), HSMUC1A_PEA_1_T31 (SEQ ID NO: 456), HSMUC1A_PEA_1_T33 (SEQ ID NO: 457), HSMUC1A_PEA_1_T34 (SEQ ID NO: 458), HSMUC1A_PEA_1_T35 (SEQ ID NO: 459), HSMUC1A_PEA_1_T36 (SEQ ID NO: 460), HSMUC1A_PEA_1_T40 (SEQ ID NO: 461), HSMUC1A_PEA_1_T42 (SEQ ID NO: 462), HSMUC1A_PEA_1_T43 (SEQ ID NO: 463) and HSMUC1A_PEA_1_T47 (SEQ ID NO: 464). Table 38 below describes the starting and ending position of this segment on each transcript.

TABLE 38

Segment location on transcripts

| Transcript name | Segment starting position | Segment ending position |
|---|---|---|
| HSMUC1A_PEA_1_T12 (SEQ ID NO: 451) | 565 | 573 |
| HSMUC1A_PEA_1_T26 (SEQ ID NO: 452) | 565 | 573 |
| HSMUC1A_PEA_1_T28 (SEQ ID NO: 453) | 565 | 573 |
| HSMUC1A_PEA_1_T29 (SEQ ID NO: 454) | 592 | 600 |
| HSMUC1A_PEA_1_T30 (SEQ ID NO: 455) | 565 | 573 |
| HSMUC1A_PEA_1_T31 (SEQ ID NO: 456) | 565 | 573 |
| HSMUC1A_PEA_1_T33 (SEQ ID NO: 457) | 565 | 573 |
| HSMUC1A_PEA_1_T34 (SEQ ID NO: 458) | 592 | 600 |
| HSMUC1A_PEA_1_T35 (SEQ ID NO: 459) | 565 | 573 |
| HSMUC1A_PEA_1_T36 (SEQ ID NO: 460) | 565 | 573 |
| HSMUC1A_PEA_1_T40 (SEQ ID NO: 461) | 592 | 600 |
| HSMUC1A_PEA_1_T42 (SEQ ID NO: 462) | 565 | 573 |
| HSMUC1A_PEA_1_T43 (SEQ ID NO: 463) | 592 | 600 |
| HSMUC1A_PEA_1_T47 (SEQ ID NO: 464) | 565 | 573 |

Segment cluster HSMUC1A_PEA_1_node_5 (SEQ ID NO: 473) according to the present invention is supported by 34 libraries. The number of libraries was determined as previously described. This segment can be found in the following transcript(s): HSMUC1A_PEA_1_T12 (SEQ ID NO: 451), HSMUC1A_PEA_1_T26 (SEQ ID NO: 452), HSMUC1A_PEA_1_T28 (SEQ ID NO: 453), HSMUC1A_PEA_1_T29 (SEQ ID NO: 454), HSMUC1A_PEA_1_T30 (SEQ ID NO: 455), HSMUC1A_PEA_1_T31 (SEQ ID NO: 456), HSMUC1A_PEA_1_T33 (SEQ ID NO: 457), HSMUC1A_PEA_1_T34 (SEQ ID NO: 458), HSMUC1A_PEA_1_T35 (SEQ ID NO: 459), HSMUC1A_PEA_1_T36 (SEQ ID NO: 460), HSMUC1A_PEA_1_T40 (SEQ ID NO: 461), HSMUC1A_PEA_1_T42 (SEQ ID NO: 462), HSMUC1A_PEA_1_T43 (SEQ ID NO: 463) and HSMUC1A_PEA_1_T47 (SEQ ID NO: 464). Table 39 below describes the starting and ending position of this segment on each transcript.

TABLE 39

Segment location on transcripts

| Transcript name | Segment starting position | Segment ending position |
|---|---|---|
| HSMUC1A_PEA_1_T12 (SEQ ID NO: 451) | 574 | 600 |
| HSMUC1A_PEA_1_T26 (SEQ ID NO: 452) | 574 | 600 |
| HSMUC1A_PEA_1_T28 (SEQ ID NO: 453) | 574 | 600 |
| HSMUC1A_PEA_1_T29 (SEQ ID NO: 454) | 601 | 627 |
| HSMUC1A_PEA_1_T30 (SEQ ID NO: 455) | 574 | 600 |
| HSMUC1A_PEA_1_T31 (SEQ ID NO: 456) | 574 | 600 |
| HSMUC1A_PEA_1_T33 (SEQ ID NO: 457) | 574 | 600 |
| HSMUC1A_PEA_1_T34 (SEQ ID NO: 458) | 601 | 627 |
| HSMUC1A_PEA_1_T35 (SEQ ID NO: 459) | 574 | 600 |
| HSMUC1A_PEA_1_T36 (SEQ ID NO: 460) | 574 | 600 |
| HSMUC1A_PEA_1_T40 (SEQ ID NO: 461) | 601 | 627 |
| HSMUC1A_PEA_1_T42 (SEQ ID NO: 462) | 574 | 600 |
| HSMUC1A_PEA_1_T43 (SEQ ID NO: 463) | 601 | 627 |
| HSMUC1A_PEA_1_T47 (SEQ ID NO: 464) | 574 | 600 |

Segment cluster HSMUC1A_PEA_1_node_6 (SEQ ID NO: 474) according to the present invention is supported by 35 libraries. The number of libraries was determined as previously described. This segment can be found in the following transcript(s): HSMUC1A_PEA_1_T12 (SEQ ID NO: 451), HSMUC1A_PEA_1_T26 (SEQ ID NO: 452), HSMUC1A_PEA_1_T28 (SEQ ID NO: 453), HSMUC1A_PEA_1_T29 (SEQ ID NO: 454), HSMUC1A_PEA_1_T30 (SEQ ID NO: 455), HSMUC1A_PEA_1_T31 (SEQ ID NO: 456), HSMUC1A_PEA_1_T33 (SEQ ID NO: 457), HSMUC1A_PEA_1_T34 (SEQ ID NO: 458), HSMUC1A_PEA_1_T35 (SEQ ID NO: 459), HSMUC1A_PEA_1_T36 (SEQ ID NO: 460), HSMUC1A_PEA_1_T40 (SEQ ID NO: 461), HSMUC1A_PEA_1_T42 (SEQ ID NO: 462), HSMUC1A_PEA_1_T43 (SEQ ID NO: 463) and HSMUC1A_PEA_1_T47 (SEQ ID NO: 464). Table 40 below describes the starting and ending position of this segment on each transcript.

TABLE 40

Segment location on transcripts

| Transcript name | Segment starting position | Segment ending position |
|---|---|---|
| HSMUC1A_PEA_1_T12 (SEQ ID NO: 451) | 601 | 638 |
| HSMUC1A_PEA_1_T26 (SEQ ID NO: 452) | 601 | 638 |
| HSMUC1A_PEA_1_T28 (SEQ ID NO: 453) | 601 | 638 |
| HSMUC1A_PEA_1_T29 (SEQ ID NO: 454) | 628 | 665 |
| HSMUC1A_PEA_1_T30 (SEQ ID NO: 455) | 601 | 638 |
| HSMUC1A_PEA_1_T31 (SEQ ID NO: 456) | 601 | 638 |
| HSMUC1A_PEA_1_T33 (SEQ ID NO: 457) | 601 | 638 |
| HSMUC1A_PEA_1_T34 (SEQ ID NO: 458) | 628 | 665 |
| HSMUC1A_PEA_1_T35 (SEQ ID NO: 459) | 601 | 638 |
| HSMUC1A_PEA_1_T36 (SEQ ID NO: 460) | 601 | 638 |

TABLE 40-continued

Segment location on transcripts

| Transcript name | Segment starting position | Segment ending position |
|---|---|---|
| HSMUC1A_PEA_1_T40 (SEQ ID NO: 461) | 628 | 665 |
| HSMUC1A_PEA_1_T42 (SEQ ID NO: 462) | 601 | 638 |
| HSMUC1A_PEA_1_T43 (SEQ ID NO: 463) | 628 | 665 |
| HSMUC1A_PEA_1_T47 (SEQ ID NO: 464) | 601 | 638 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in regard to ovarian cancer), shown in Table 41.

TABLE 41

Oligonucleotides related to this segment

| Oligonucleotide name | Overexpressed in cancers | Chip reference |
|---|---|---|
| HSMUC1A_0_37_0 (SEQ ID NO:1028) | ovarian carcinoma | OVA |

Segment cluster HSMUC1A_PEA_1_node_7 (SEQ ID NO: 475) according to the present invention is supported by 32 libraries. The number of libraries was determined as previously described. This segment can be found in the following transcript(s): HSMUC1A_PEA_1_T12 (SEQ ID NO: 451), HSMUC1A_PEA_1_T26 (SEQ ID NO: 452), HSMUC1A_PEA_1_T28 (SEQ ID NO: 453), HSMUC1A_PEA_1_T29 (SEQ ID NO: 454), HSMUC1A_PEA_1_T30 (SEQ ID NO: 455), HSMUC1A_PEA_1_T31 (SEQ ID NO: 456), HSMUC1A_PEA_1_T33 (SEQ ID NO: 457), HSMUC1A_PEA_1_T34 (SEQ ID NO: 458), HSMUC1A_PEA_1_T35 (SEQ ID NO: 459), HSMUC1A_PEA_1_T36 (SEQ ID NO: 460), HSMUC1A_PEA_1_T40 (SEQ ID NO: 461), HSMUC1A_PEA_1_T42 (SEQ ID NO: 462) and HSMUC1A_PEA_1_T43 (SEQ ID NO: 463). Table 42 below describes the starting and ending position of this segment on each transcript.

TABLE 42

Segment location on transcripts

| Transcript name | Segment starting position | Segment ending position |
|---|---|---|
| HSMUC1A_PEA_1_T12 (SEQ ID NO:451) | 639 | 665 |
| HSMUC1A_PEA_1_T26 (SEQ ID NO:452) | 639 | 665 |
| HSMUC1A_PEA_1_T28 (SEQ ID NO:453) | 639 | 665 |
| HSMUC1A_PEA_1_T29 (SEQ ID NO:454) | 666 | 692 |
| HSMUC1A_PEA_1_T30 (SEQ ID NO:455) | 639 | 665 |
| HSMUC1A_PEA_1_T31 (SEQ ID NO:456) | 639 | 665 |
| HSMUC1A_PEA_1_T33 (SEQ ID NO:457) | 639 | 665 |
| HSMUC1A_PEA_1_T34 (SEQ ID NO:458) | 666 | 692 |
| HSMUC1A_PEA_1_T35 (SEQ ID NO:459) | 639 | 665 |
| HSMUC1A_PEA_1_T36 (SEQ ID NO:460) | 639 | 665 |
| HSMUC1A_PEA_1_T40 (SEQ ID NO:461) | 666 | 692 |
| HSMUC1A_PEA_1_T42 (SEQ ID NO:462) | 639 | 665 |
| HSMUC1A_PEA_1_T43 (SEQ ID NO:463) | 666 | 692 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in regard to ovarian cancer), shown in Table 43.

TABLE 43

Oligonucleotides related to this segment

| Oligonucleotide name | Overexpressed in cancers | Chip reference |
|---|---|---|
| HSMUC1A_0_37_0 (SEQ ID NO:1028) | ovarian carcinoma | OVA |

Segment cluster HSMUC1A_PEA_1_node_17 (SEQ ID NO: 476) according to the present invention can be found in the following transcript(s): HSMUC1A_PEA_1_T28 (SEQ ID NO: 453), HSMUC1A_PEA_1_T33 (SEQ ID NO: 457) and HSMUC1A_PEA_1_T40 (SEQ ID NO: 461). Table 44 below describes the starting and ending position of this segment on each transcript.

TABLE 44

Segment location on transcripts

| Transcript name | Segment starting position | Segment ending position |
|---|---|---|
| HSMUC1A_PEA_1_T28 (SEQ ID NO:453) | 666 | 684 |
| HSMUC1A_PEA_1_T33 (SEQ ID NO:457) | 666 | 684 |
| HSMUC1A_PEA_1_T40 (SEQ ID NO:461) | 693 | 711 |

Segment cluster HSMUC1A_PEA_1_node_18 (SEQ ID NO: 477) according to the present invention is supported by 90 libraries. The number of libraries was determined as previously described. This segment can be found in the following transcript(s): HSMUC1A_PEA_1_T12 (SEQ ID NO: 451), HSMUC1A_PEA_1_T26 (SEQ ID NO: 452), HSMUC1A_PEA_1_T28 (SEQ ID NO: 453), HSMUC1A_PEA_1_T29 (SEQ ID NO: 454), HSMUC1A_PEA_1_T30 (SEQ ID NO: 455), HSMUC1A_PEA_1_T33 (SEQ ID NO: 457), HSMUC1A_PEA_1_T35 (SEQ ID NO: 459), HSMUC1A_PEA_1_T40 (SEQ ID NO: 461) and HSMUC1A_PEA_1_T42 (SEQ ID NO: 462). Table 45 below describes the starting and ending position of this segment on each transcript.

TABLE 45

Segment location on transcripts

| Transcript name | Segment starting position | Segment ending position |
|---|---|---|
| HSMUC1A_PEA_1_T12 (SEQ ID NO:451) | 842 | 891 |
| HSMUC1A_PEA_1_T26 (SEQ ID NO:452) | 666 | 715 |
| HSMUC1A_PEA_1_T28 (SEQ ID NO:453) | 685 | 734 |
| HSMUC1A_PEA_1_T29 (SEQ ID NO:454) | 693 | 742 |
| HSMUC1A_PEA_1_T30 (SEQ ID NO:455) | 666 | 715 |
| HSMUC1A_PEA_1_T33 (SEQ ID NO:457) | 685 | 734 |
| HSMUC1A_PEA_1_T35 (SEQ ID NO:459) | 666 | 715 |
| HSMUC1A_PEA_1_T40 (SEQ ID NO:461) | 712 | 761 |
| HSMUC1A_PEA_1_T42 (SEQ ID NO:462) | 666 | 715 |

Segment cluster HSMUC1A_PEA_1_node_20 (SEQ ID NO: 478) according to the present invention can be found in the following transcript(s): HSMUC1A_PEA_1_T12 (SEQ ID NO: 451), HSMUC1A_PEA_1_T26 (SEQ ID NO: 452), HSMUC1A_PEA_1_T28 (SEQ ID NO: 453), HSMUC1A_PEA_1_T33 (SEQ ID NO: 457), HSMUC1A_PEA_1_T35 (SEQ ID NO: 459) and HSMUC1A_PEA_1_T42 (SEQ ID NO: 462). Table 46 below describes the starting and ending position of this segment on each transcript.

TABLE 46

Segment location on transcripts

| Transcript name | Segment starting position | Segment ending position |
|---|---|---|
| HSMUC1A_PEA_1_T12 (SEQ ID NO:451) | 892 | 900 |
| HSMUC1A_PEA_1_T26 (SEQ ID NO:452) | 716 | 724 |
| HSMUC1A_PEA_1_T28 (SEQ ID NO:453) | 735 | 743 |
| HSMUC1A_PEA_1_T33 (SEQ ID NO:457) | 735 | 743 |
| HSMUC1A_PEA_1_T35 (SEQ ID NO:459) | 716 | 724 |
| HSMUC1A_PEA_1_T42 (SEQ ID NO:462) | 716 | 724 |

Segment cluster HSMUC1A_PEA_1_node_21 (SEQ ID NO: 479) according to the present invention is supported by 97 libraries. The number of libraries was determined as previously described. This segment can be found in the following transcript(s): HSMUC1A_PEA_1_T12 (SEQ ID NO: 451), HSMUC1A_PEA_1_T26 (SEQ ID NO: 452), HSMUC1A_PEA_1_T28 (SEQ ID NO: 453), HSMUC1A_PEA_1_T33 (SEQ ID NO: 457), HSMUC1A_PEA_1_T35 (SEQ ID NO: 459) and HSMUC1A_PEA_1_T42 (SEQ ID NO: 462). Table 47 below describes the starting and ending position of this segment on each transcript.

TABLE 47

Segment location on transcripts

| Transcript name | Segment starting position | Segment ending position |
|---|---|---|
| HSMUC1A_PEA_1_T12 (SEQ ID NO:451) | 901 | 947 |
| HSMUC1A_PEA_1_T26 (SEQ ID NO:452) | 725 | 771 |
| HSMUC1A_PEA_1_T28 (SEQ ID NO:453) | 744 | 790 |
| HSMUC1A_PEA_1_T33 (SEQ ID NO:457) | 744 | 790 |
| HSMUC1A_PEA_1_T35 (SEQ ID NO:459) | 725 | 771 |
| HSMUC1A_PEA_1_T42 (SEQ ID NO:462) | 725 | 771 |

Segment cluster HSMUC1A_PEA_1_node_23 (SEQ ID NO: 480) according to the present invention can be found in the following transcript(s): HSMUC1A_PEA_1_T12 (SEQ ID NO: 451). Table 48 below describes the starting and ending position of this segment on each transcript.

TABLE 48

Segment location on transcripts

| Transcript name | Segment starting position | Segment ending position |
|---|---|---|
| HSMUC1A_PEA_1_T12 (SEQ ID NO:451) | 948 | 952 |

Segment cluster HSMUC1A_PEA_1_node_26 (SEQ ID NO: 481) according to the present invention is supported by 129 libraries. The number of libraries was determined as previously described. This segment can be found in the following transcript(s): HSMUC1A_PEA_1_T12 (SEQ ID NO: 451), HSMUC1A_PEA_1_T26 (SEQ ID NO: 452), HSMUC1A_PEA_1_T28 (SEQ ID NO: 453), HSMUC1A_PEA_1_T29 (SEQ ID NO: 454), HSMUC1A_PEA_1_T30 (SEQ ID NO: 455) and HSMUC1A_PEA_1_T31 (SEQ ID NO: 456). Table 49 below describes the starting and ending position of this segment on each transcript.

TABLE 49

Segment location on transcripts

| Transcript name | Segment starting position | Segment ending position |
|---|---|---|
| HSMUC1A_PEA_1_T12 (SEQ ID NO:451) | 1085 | 1116 |
| HSMUC1A_PEA_1_T26 (SEQ ID NO:452) | 772 | 803 |
| HSMUC1A_PEA_1_T28 (SEQ ID NO:453) | 791 | 822 |
| HSMUC1A_PEA_1_T29 (SEQ ID NO:454) | 743 | 774 |
| HSMUC1A_PEA_1_T30 (SEQ ID NO:455) | 716 | 747 |

TABLE 49-continued

Segment location on transcripts

| Transcript name | Segment starting position | Segment ending position |
|---|---|---|
| HSMUC1A_PEA_1_T31 (SEQ ID NO:456) | 666 | 697 |

Segment cluster HSMUC1A_PEA_1_node_27 (SEQ ID NO: 482) according to the present invention is supported by 140 libraries. The number of libraries was determined as previously described. This segment can be found in the following transcript(s): HSMUC1A_PEA_1_T12 (SEQ ID NO: 451), HSMUC1A_PEA_1_T26 (SEQ ID NO: 452), HSMUC1A_PEA_1_T28 (SEQ ID NO: 453), HSMUC1A_PEA_1_T29 (SEQ ID NO: 454), HSMUC1A_PEA_1_T30 (SEQ ID NO: 455), HSMUC1A_PEA_1_T31 (SEQ ID NO: 456), HSMUC1A_PEA_1_T33 (SEQ ID NO: 457), HSMUC1A_PEA_1_T34 (SEQ ID NO: 458), HSMUC1A_PEA_1_T35 (SEQ ID NO: 459) and HSMUC1A_PEA_1_T36 (SEQ ID NO: 460). Table 50 below describes the starting and ending position of this segment on each transcript.

TABLE 50

Segment location on transcripts

| Transcript name | Segment starting position | Segment ending position |
|---|---|---|
| HSMUC1A_PEA_1_T12 (SEQ ID NO:451) | 1117 | 1206 |
| HSMUC1A_PEA_1_T26 (SEQ ID NO:452) | 804 | 893 |
| HSMUC1A_PEA_1_T28 (SEQ ID NO:453) | 823 | 912 |
| HSMUC1A_PEA_1_T29 (SEQ ID NO:454) | 775 | 864 |
| HSMUC1A_PEA_1_T30 (SEQ ID NO:455) | 748 | 837 |
| HSMUC1A_PEA_1_T31 (SEQ ID NO:456) | 698 | 787 |
| HSMUC1A_PEA_1_T33 (SEQ ID NO:457) | 791 | 880 |
| HSMUC1A_PEA_1_T34 (SEQ ID NO:458) | 693 | 782 |
| HSMUC1A_PEA_1_T35 (SEQ ID NO:459) | 772 | 861 |
| HSMUC1A_PEA_1_T36 (SEQ ID NO:460) | 666 | 755 |

Segment cluster HSMUC1A_PEA_1_node_31 (SEQ ID NO: 483) according to the present invention can be found in the following transcript(s): HSMUC1A_PEA_1_T12 (SEQ ID NO: 451), HSMUC1A_PEA_1_T26 (SEQ ID NO: 452), HSMUC1A_PEA_1_T28 (SEQ ID NO: 453), HSMUC1A_PEA_1_T29 (SEQ ID NO: 454), HSMUC1A_PEA_1_T30 (SEQ ID NO: 455), HSMUC1A_PEA_1_T31 (SEQ ID NO: 456), HSMUC1A_PEA_1_T33 (SEQ ID NO: 457), HSMUC1A_PEA_1_T34 (SEQ ID NO: 458), HSMUC1A_PEA_1_T35 (SEQ ID NO: 459), HSMUC1A_PEA_1_T36 (SEQ ID NO: 460), HSMUC1A_PEA_1_T40 (SEQ ID NO: 461), HSMUC1A_PEA_1_T42 (SEQ ID NO: 462) and HSMUC1A_PEA_1_T43 (SEQ ID NO: 463). Table 51 below describes the starting and ending position of this segment on each transcript.

TABLE 51

Segment location on transcripts

| Transcript name | Segment starting position | Segment ending position |
|---|---|---|
| HSMUC1A_PEA_1_T12 (SEQ ID NO:451) | 1347 | 1356 |
| HSMUC1A_PEA_1_T26 (SEQ ID NO:452) | 1034 | 1043 |
| HSMUC1A_PEA_1_T28 (SEQ ID NO:453) | 1053 | 1062 |
| HSMUC1A_PEA_1_T29 (SEQ ID NO:454) | 1005 | 1014 |
| HSMUC1A_PEA_1_T30 (SEQ ID NO:455) | 978 | 987 |
| HSMUC1A_PEA_1_T31 (SEQ ID NO:456) | 928 | 937 |
| HSMUC1A_PEA_1_T33 (SEQ ID NO:457) | 1021 | 1030 |
| HSMUC1A_PEA_1_T34 (SEQ ID NO:458) | 923 | 932 |
| HSMUC1A_PEA_1_T35 (SEQ ID NO:459) | 1002 | 1011 |
| HSMUC1A_PEA_1_T36 (SEQ ID NO:460) | 896 | 905 |
| HSMUC1A_PEA_1_T40 (SEQ ID NO:461) | 902 | 911 |
| HSMUC1A_PEA_1_T42 (SEQ ID NO:462) | 912 | 921 |
| HSMUC1A_PEA_1_T43 (SEQ ID NO:463) | 833 | 842 |

Segment cluster HSMUC1A_PEA_1_node_34 (SEQ ID NO: 484) according to the present invention is supported by 24 libraries. The number of libraries was determined as previously described. This segment can be found in the following transcript(s): HSMUC1A_PEA_1_T47 (SEQ ID NO: 464). Table 52 below describes the starting and ending position of this segment on each transcript.

TABLE 52

Segment location on transcripts

| Transcript name | Segment starting position | Segment ending position |
|---|---|---|
| HSMUC1A_PEA_1_T47 (SEQ ID NO:464) | 639 | 665 |

Segment cluster HSMUC1A_PEA_1_node_36 (SEQ ID NO: 485) according to the present invention is supported by 135 libraries. The number of libraries was determined as previously described. This segment can be found in the following transcript(s): HSMUC1A_PEA_1_T12 (SEQ ID NO: 451), HSMUC1A_PEA_1_T26 (SEQ ID NO: 452), HSMUC1A_PEA_1_T28 (SEQ ID NO: 453), HSMUC1A_PEA_1_T29 (SEQ ID NO: 454), HSMUC1A_PEA_1_T30 (SEQ ID NO: 455), HSMUC1A_PEA_1_T31 (SEQ ID NO: 456), HSMUC1A_PEA_1_T33 (SEQ ID NO: 457), HSMUC1A_PEA_1_T34 (SEQ ID NO: 458), HSMUC1A_PEA_1_T35 (SEQ ID NO: 459), HSMUC1A_PEA_1_T36 (SEQ ID NO: 460), HSMUC1A_PEA_1_T40 (SEQ ID NO: 461), HSMUC1A_PEA_1_T42 (SEQ ID NO: 462), HSMUC1A_PEA_1_T43 (SEQ ID NO: 463) and HSMUC1A_PEA_1_T47 (SEQ ID NO: 464). Table 53 below describes the starting and ending position of this segment on each transcript.

TABLE 53

Segment location on transcripts

| Transcript name | Segment starting position | Segment ending position |
|---|---|---|
| HSMUC1A_PEA_1_T12 (SEQ ID NO:451) | 1357 | 1388 |
| HSMUC1A_PEA_1_T26 (SEQ ID NO:452) | 1044 | 1075 |
| HSMUC1A_PEA_1_T28 (SEQ ID NO:453) | 1063 | 1094 |
| HSMUC1A_PEA_1_T29 (SEQ ID NO:454) | 1015 | 1046 |
| HSMUC1A_PEA_1_T30 (SEQ ID NO:455) | 988 | 1019 |
| HSMUC1A_PEA_1_T31 (SEQ ID NO:456) | 938 | 969 |
| HSMUC1A_PEA_1_T33 (SEQ ID NO:457) | 1031 | 1062 |
| HSMUC1A_PEA_1_T34 (SEQ ID NO:458) | 933 | 964 |
| HSMUC1A_PEA_1_T35 (SEQ ID NO:459) | 1012 | 1043 |
| HSMUC1A_PEA_1_T36 (SEQ ID NO:460) | 906 | 937 |
| HSMUC1A_PEA_1_T40 (SEQ ID NO:461) | 912 | 943 |
| HSMUC1A_PEA_1_T42 (SEQ ID NO:462) | 922 | 953 |
| HSMUC1A_PEA_1_T43 (SEQ ID NO:463) | 843 | 874 |
| HSMUC1A_PEA_1_T47 (SEQ ID NO:464) | 1190 | 1221 |

Segment cluster HSMUC1A_PEA_1_node_37 (SEQ ID NO: 486) according to the present invention is supported by 146 libraries. The number of libraries was determined as previously described. This segment can be found in the following transcript(s): HSMUC1A_PEA_1_T12 (SEQ ID NO: 451), HSMUC1A_PEA_1_T26 (SEQ ID NO: 452), HSMUC1A_PEA_1_T28 (SEQ ID NO: 453), HSMUC1A_PEA_1_T29 (SEQ ID NO: 454), HSMUC1A_PEA_1_T30 (SEQ ID NO: 455), HSMUC1A_PEA_1_T31 (SEQ ID NO: 456), HSMUC1A_PEA_1_T33 (SEQ ID NO: 457), HSMUC1A_PEA_1_T34 (SEQ ID NO: 458), HSMUC1A_PEA_1_T35 (SEQ ID NO: 459), HSMUC1A_PEA_1_T36 (SEQ ID NO: 460), HSMUC1A_PEA_1_T40 (SEQ ID NO: 461), HSMUC1A_PEA_1_T42 (SEQ ID NO: 462), HSMUC1A_PEA_1_T43 (SEQ ID NO: 463) and HSMUC1A_PEA_1_T47 (SEQ ID NO: 464). Table 54 below describes the starting and ending position of this segment on each transcript.

TABLE 54

Segment location on transcripts

| Transcript name | Segment starting position | Segment ending position |
|---|---|---|
| HSMUC1A_PEA_1_T12 (SEQ ID NO:451) | 1389 | 1487 |
| HSMUC1A_PEA_1_T26 (SEQ ID NO:452) | 1076 | 1174 |
| HSMUC1A_PEA_1_T28 (SEQ ID NO:453) | 1095 | 1193 |
| HSMUC1A_PEA_1_T29 (SEQ ID NO:454) | 1047 | 1145 |
| HSMUC1A_PEA_1_T30 (SEQ ID NO:455) | 1020 | 1118 |
| HSMUC1A_PEA_1_T31 (SEQ ID NO:456) | 970 | 1068 |
| HSMUC1A_PEA_1_T33 (SEQ ID NO:457) | 1063 | 1161 |
| HSMUC1A_PEA_1_T34 (SEQ ID NO:458) | 965 | 1063 |
| HSMUC1A_PEA_1_T35 (SEQ ID NO:459) | 1044 | 1142 |
| HSMUC1A_PEA_1_T36 (SEQ ID NO:460) | 938 | 1036 |
| HSMUC1A_PEA_1_T40 (SEQ ID NO:461) | 944 | 1042 |
| HSMUC1A_PEA_1_T42 (SEQ ID NO:462) | 954 | 1052 |
| HSMUC1A_PEA_1_T43 (SEQ ID NO:463) | 875 | 973 |
| HSMUC1A_PEA_1_T47 (SEQ ID NO:464) | 1222 | 1320 |

Variant protein alignment to the previously known protein:

Sequence name: MUC1_HUMAN

Sequence documentation:

Alignment of: HSMUC1A_PEA_1_P63 (SEQ ID NO: 501) x MUC1_HUMAN ...

Alignment segment 1/1:

Quality: 429.00

Escore: 0

Matching length: 59 Total length: 59

Matching Percent Similarity: 86.44 Matching Percent Identity: 81.36

Total Percent Similarity: 86.44 Total Percent Identity: 81.36

Gaps: 0

Alignment:

```
1 MTPGTQSPFFLLLLLTVLTVVTGSGHASSTPGGEKETSATQRSSVEEEVS 50
  |||||||||||||||||||||||||||||||||||||||||||| ||||
1 MTPGTQSPFFLLLLLTVLTVVTGSGHASSTPGGEKETSATQRSSVPSSTE 50

51 ADQVSVGAS 59
   : || : :|
51 KNAVSMTSS 59
```

Combined expression of 6 sequences (T10888-junc11-17 (SEQ ID NO: 962); R11723-seg13 (SEQ ID NO: 975); H61775-seg8-F2R2 (SEQ ID NO: 957); Z44808-junc8-11 (SEQ ID NO: 1006); Z25299-seg20 (SEQ ID NO: 996); Z25299-seg23 (SEQ ID NO: 999)) in normal and cancerous ovary tissues Expression of CEA6_HUMAN Carcinoembryonic antigen-related cell adhesion molecule 6; R11723-hypothetical protein PSEC0181 (PSEC); immunoglobulin superfamily, member 9; SMO2_HUMAN SPARC related modular calcium-binding protein 2 precursor; Secretory leukocyte protease inhibitor Acid-stable proteinase inhibitor; transcripts detectable by or according to the amplicons: T10888-junc11-17 (SEQ ID NO: 962); R11723-seg13 (SEQ ID NO: 975); H61775-seg8-F2R2 (SEQ ID NO: 957); Z44808-junc8-11 (SEQ ID NO: 1006); Z25299-seg20 (SEQ ID NO: 996); Z25299-seg23 (SEQ ID NO: 999) amplicon(s) and the primers: T10888-junc11-17-F (SEQ ID NO: 960) and T10888-junc11-17-R (SEQ ID NO: 961); R11723-seg1-F (SEQ ID NO: 973) and R11723-seg13-R (SEQ ID NO: 974); H61775-seg8-F2 (SEQ ID NO: 955) and H61775-seg8-R2 (SEQ ID NO: 956); Z44808-junc8-11-F (SEQ ID NO: 1004) and Z44808-junc8-11-R (SEQ ID NO: 1005); Z25299-seg20-F (SEQ ID NO: 994) and Z25299-seg20-R (SEQ ID NO: 995); Z25299-seg23-F (SEQ ID NO: 997) and Z25299-seg23-R (SEQ ID NO: 998), was measured by real time PCR. In parallel the expression of four housekeeping genes —PBGD (GenBank Accession No. BC019323 (SEQ ID NO:1036); amplicon—PBGD-amplicon (SEQ ID NO:1039)), HPRT1 (GenBank Accession No. NM_000194 (SEQ ID NO:1040); amplicon—HPRT1-amplicon (SEQ ID NO:1044) and SDHA (GenBank Accession No. NM_004168 (SEQ ID NO: 1032); amplicon—SDHA-amplicon (SEQ ID NO:1035)), GAPDH (GenBank Accession No. BC026907; GAPDH amplicon (SEQ ID NO:1047)) was measured similarly. For each RT sample, the expression of the above amplicons was normalized to the geometric mean of the quantities of the housekeeping genes. The normalized quantity of each RT sample of each amplicon was then divided by the median of the quantities of the normal post-mortem (PM) samples detected for the same amplicon (Sample Nos. 45-48, 71 Table 1, "Tissue samples in testing sample", above), to obtain a value of fold up-regulation for each sample relative to median of the normal PM samples. The reciprocal of this ratio was calculated for Z44808-junc8-11 (SEQ ID NO: 1006), to obtain a value of fold down-regulation for each sample relative to median of the normal PM samples.

Figure 43:
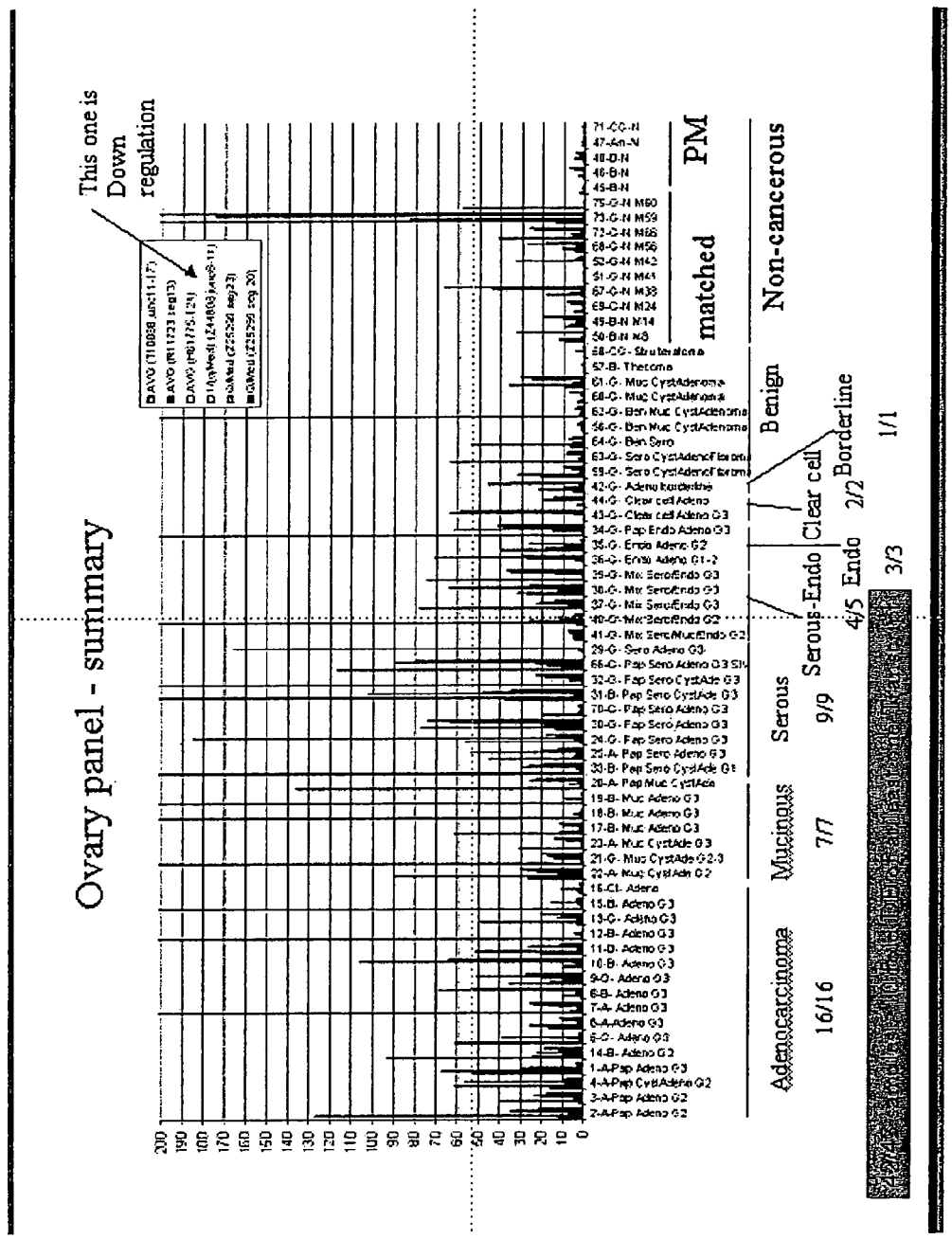
FIG. 43 is a histogram showing differential expression of a variety of transcripts in cancerous ovary samples relative to the normal samples.

FIG. 43 is a histogram showing differential expression of the above-indicated transcripts in cancerous ovary samples relative to the normal samples. The number and percentage of samples that exhibit at least 10 fold differential of at least one of the sequences, out of the total number of samples tested is indicated in the bottom.

As is evident from FIG. 43, differential expression of at least 10 fold in at least one of the sequences was found in 42 out of 43 cancerous samples.

DESCRIPTION FOR CLUSTER HUMCEA

Cluster HUMCEA features 5 transcript(s) and 42 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| HUMCEA_PEA_1_T8 | 502 |
| HUMCEA_PEA_1_T9 | 503 |
| HUMCEA_PEA_1_T20 | 504 |
| HUMCEA_PEA_1_T25 | 505 |
| HUMCEA_PEA_1_T26 | 506 |

TABLE 2

Segments of interest

| Segment Name | SEQ ID NO: |
|---|---|
| HUMCEA_PEA_1_node_0 | 507 |
| HUMCEA_PEA_1_node_2 | 508 |
| HUMCEA_PEA_1_node_11 | 509 |
| HUMCEA_PEA_1_node_12 | 510 |
| HUMCEA_PEA_1_node_31 | 511 |
| HUMCEA_PEA_1_node_36 | 512 |
| HUMCEA_PEA_1_node_44 | 513 |
| HUMCEA_PEA_1_node_46 | 514 |
| HUMCEA_PEA_1_node_63 | 515 |
| HUMCEA_PEA_1_node_65 | 516 |
| HUMCEA_PEA_1_node_67 | 517 |
| HUMCEA_PEA_1_node_3 | 518 |
| HUMCEA_PEA_1_node_7 | 519 |
| HUMCEA_PEA_1_node_8 | 520 |
| HUMCEA_PEA_1_node_9 | 521 |
| HUMCEA_PEA_1_node_10 | 522 |
| HUMCEA_PEA_1_node_15 | 523 |
| HUMCEA_PEA_1_node_16 | 524 |
| HUMCEA_PEA_1_node_17 | 525 |
| HUMCEA_PEA_1_node_18 | 526 |
| HUMCEA_PEA_1_node_19 | 527 |
| HUMCEA_PEA_1_node_20 | 528 |
| HUMCEA_PEA_1_node_21 | 529 |
| HUMCEA_PEA_1_node_22 | 530 |
| HUMCEA_PEA_1_node_23 | 531 |
| HUMCEA_PEA_1_node_24 | 532 |
| HUMCEA_PEA_1_node_27 | 533 |
| HUMCEA_PEA_1_node_29 | 534 |
| HUMCEA_PEA_1_node_30 | 535 |
| HUMCEA_PEA_1_node_33 | 536 |
| HUMCEA_PEA_1_node_34 | 537 |
| HUMCEA_PEA_1_node_35 | 538 |

TABLE 2-continued

Segments of interest

| Segment Name | SEQ ID NO: |
|---|---|
| HUMCEA_PEA_1_node_45 | 539 |
| HUMCEA_PEA_1_node_50 | 540 |
| HUMCEA_PEA_1_node_51 | 541 |
| HUMCEA_PEA_1_node_56 | 542 |
| HUMCEA_PEA_1_node_57 | 543 |
| HUMCEA_PEA_1_node_58 | 544 |
| HUMCEA_PEA_1_node_60 | 545 |
| HUMCEA_PEA_1_node_61 | 546 |
| HUMCEA_PEA_1_node_62 | 547 |
| HUMCEA_PEA_1_node_64 | 548 |

TABLE 3

Proteins of interest

| Protein Name | SEQ ID NO: | Corresponding Transcript(s) |
|---|---|---|
| HUMCEA_PEA_1_P4 | 550 | HUMCEA_PEA_1_T8 (SEQ ID NO:502) |
| HUMCEA_PEA_1_P5 | 551 | HUMCEA_PEA_1_T9 (SEQ ID NO:503) |
| HUMCEA_PEA_1_P14 | 552 | HUMCEA_PEA_1_T20 (SEQ ID NO:504) |
| HUMCEA_PEA_1_P19 | 553 | HUMCEA_PEA_1_T25 (SEQ ID NO:505) |
| HUMCEA_PEA_1_P20 | 554 | HUMCEA_PEA_1_T26 (SEQ ID NO:506) |

These sequences are variants of the known protein Carcinoembryonic antigen-related cell adhesion molecule 5 precursor (SwissProt accession identifier CEA5_HUMAN; known also according to the synonyms Carcinoembryonic antigen; CEA; Meconium antigen 100; CD66e antigen), SEQ ID NO: 549, referred to herein as the previously known protein.

The sequence for protein Carcinoembryonic antigen-related cell adhesion molecule 5 precursor is given at the end of the application, as "Carcinoembryonic antigen-related cell adhesion molecule 5 precursor amino acid sequence". Known polymorphisms for this sequence are as shown in Table 4.

TABLE 4

Amino acid mutations for Known Protein

| SNP position(s) on amino acid sequence | Comment |
|---|---|
| 320 | Missing |

Protein Carcinoembryonic antigen-related cell adhesion molecule 5 precursor localization is believed to be Attached to the membrane by a GPI-anchor.

The previously known protein also has the following indication(s) and/or potential therapeutic use(s): Cancer. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Immunostimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Imaging agent; Anticancer; Immunostimulant; Immunoconjugate; Monoclonal antibody, murine; Antisense therapy; antibody.

The following GO Annotation(s) apply to the previously known protein. The following annotation(s) were found: integral plasma membrane protein; membrane, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster HUMCEA can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 44 below refer to weighted expression of ESTs in each category, as "parts per million" (ratio of the expression of ESTs for a particular cluster to the expression of all ESTs in that category, according to parts per million).

Figure 44:
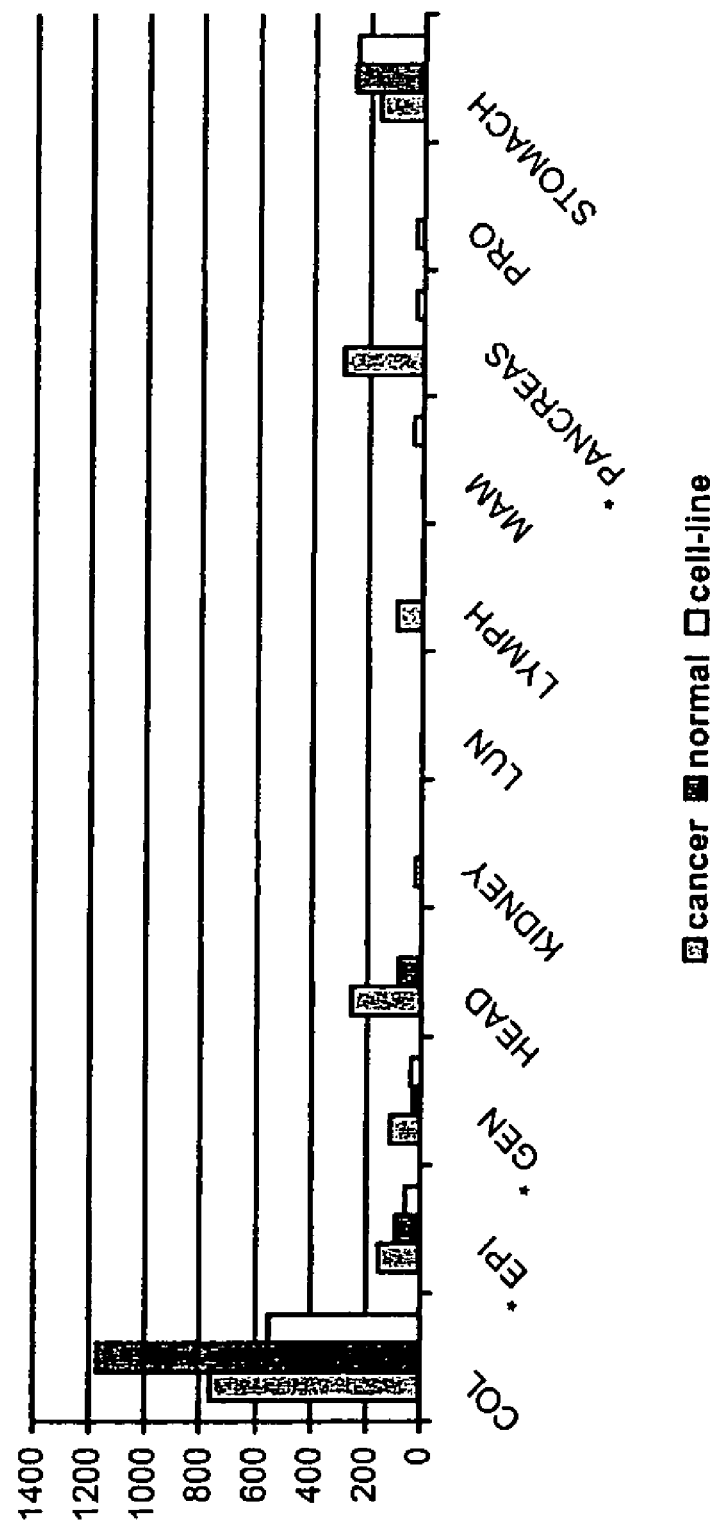
FIG. 44 shows cancer and cell-line vs. normal tissue expression.

Overall, the following results were obtained as shown with regard to the histograms in FIG. 44 and Table 5. This cluster is overexpressed (at least at a minimum level) in the following pathological conditions: epithelial malignant tumors, a mixture of malignant tumors from different tissues and pancreas carcinoma.

TABLE 5

Normal tissue distribution

| Name of Tissue | Number |
|---|---|
| colon | 1175 |
| epithelial | 92 |
| general | 29 |
| head and neck | 81 |
| kidney | 0 |
| lung | 0 |
| lymph nodes | 0 |
| breast | 0 |
| pancreas | 0 |
| prostate | 0 |
| stomach | 256 |

TABLE 6

P values and ratios for expression in cancerous tissue

| Name of Tissue | P1 | P2 | SP1 | R3 | SP2 | R4 |
|---|---|---|---|---|---|---|
| colon | 2.0e−01 | 2.7e−01 | 9.8e−01 | 0.5 | 1 | 0.5 |
| epithelial | 2.1e−03 | 2.7e−02 | 6.4e−04 | 1.4 | 2.1e−01 | 1.0 |
| general | 3.9e−08 | 8.2e−06 | 9.2e−18 | 3.2 | 1.3e−10 | 2.2 |
| head and neck | 3.4e−01 | 5.0e−01 | 2.1e−01 | 1.8 | 5.6e−01 | 0.9 |
| kidney | 4.3e−01 | 5.3e−01 | 5.8e−01 | 2.1 | 7.0e−01 | 1.6 |
| lung | 1.3e−01 | 2.6e−01 | 1 | 1.1 | 1 | 1.1 |
| lymph nodes | 3.1e−01 | 5.7e−01 | 8.1e−02 | 6.0 | 3.3e−01 | 2.5 |
| breast | 3.8e−01 | 1.5e−01 | 1 | 1.0 | 6.8e−01 | 1.5 |
| pancreas | 2.2e−02 | 2.3e−02 | 1.4e−08 | 7.8 | 7.4e−07 | 6.4 |
| prostate | 5.3e−01 | 6.0e−01 | 3.0e−01 | 2.5 | 4.2e−01 | 2.0 |
| stomach | 1.5e−01 | 4.7e−01 | 8.9e−01 | 0.6 | 7.2e−01 | 0.4 |

As noted above, cluster HUMCEA features 5 transcript(s), which were listed in Table 1 above. These transcript(s) encode for protein(s) which are variant(s) of protein Carcinoembryonic antigen-related cell adhesion molecule 5 precursor. A description of each variant protein according to the present invention is now provided.

Variant protein HUMCEA_PEA_1_P4 (SEQ ID NO: 550) according to the present invention has an amino acid sequence as given at the end of the application; it is encoded by transcript(s) HUMCEA_PEA_1_T8 (SEQ ID NO: 502). An alignment is given to the known protein (Carcinoembryonic antigen-related cell adhesion molecule 5 precursor) at the end of the application. One or more alignments to one or more previously published protein sequences are given at the end of the application. A brief description of the relationship of the variant protein according to the present invention to each such aligned protein is as follows:

Comparison report between HUMCEA_PEA_1_P4 (SEQ ID NO: 550) and CEA5_HUMAN:

1. An isolated chimeric polypeptide encoding for HUMCEA_PEA_1_P4 (SEQ ID NO: 550), comprising a first amino acid sequence being at least 90% homologous to MESPSAPPHRWCIPWQRLLLTASLLTF-WNPPTTAKLTIESTPFNVAEGKEVLLLVHNLPQ HLF-GYSWYKGERVDGNRQIIGYVIGTQQAT-PGPAYSGREIIYPNASLLIQNIIQNDTGFYT LHVIKSDLVNEEATGQFRVYPELPKP-SISSNNSKPVEDKDAVAFTCEPETQDATYLWWV NNQSLPVSPRLQLSNGNRTLTLFN-VTRNDTASYKCETQNPVSARRSDSVILNVL corresponding to amino acids 1-234 of CEA5_HUMAN, which also corresponds to amino acids 1-234 of HUMCEA_PEA_1_P4 (SEQ ID NO: 550), and a second amino acid sequence being at least 70%, optionally at least 80%, preferably at least 85%, more preferably at least 90% and most preferably at least 95% homologous to a polypeptide having the sequence CEYICSSLAQAASPNPQGQRQDFSVPLR-FKYTDPQPWTSRLSVTFCPRKTWADQVLTKN RRG-GAASVLGGSGSTPYDGRNR (SEQ ID NO: 1145) corresponding to amino acids 235-315 of HUMCEA_PEA_1_P4 (SEQ ID NO: 550), wherein said first amino acid sequence and second amino acid sequence are contiguous and in a sequential order.

2. An isolated polypeptide encoding for a tail of HUMCEA_PEA_1_P4 (SEQ ID NO: 550), comprising a polypeptide being at least 70%, optionally at least about 80%, preferably at least about 85%, more preferably at least about 90% and most preferably at least about 95% homologous to the sequence CEYICSSLAQAASPNPQGQRQDFSVPLR-FKYTDPQPWTSRLSVTFCPRKTWADQVLTKN RRG-GAASVLGGSGSTPYDGRNR (SEQ ID NO: 1145) in HUMCEA_PEA_1_P4 (SEQ ID NO: 550).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCEA_PEA_1_P4 (SEQ ID NO: 550) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein HUMCEA_PEA_1_P4 (SEQ ID NO: 550) sequence provides support for the deduced sequence of this variant protein according to the present invention).

TABLE 8

Amino acid mutations

| SNP position(s) on amino acid sequence | Alternative amino acid(s) | Previously known SNP? |
|---|---|---|
| 63 | F –> L | No |
| 80 | I –> V | Yes |
| 83 | V –> A | Yes |
| 137 | Q –> P | Yes |
| 173 | D –> N | No |

The glycosylation sites of variant protein HUMCEA_PEA_1_P4 (SEQ ID NO: 550), as compared to the known protein Carcinoembryonic antigen-related cell adhesion molecule 5 precursor, are described in Table 9 (given according to their position(s) on the amino acid sequence in the first column; the second column indicates whether the glycosylation site is present in the variant protein; and the last column indicates whether the position is different on the variant protein).

TABLE 9

Glycosylation site(s)

| Position(s) on known amino acid sequence | Present in variant protein? | Position in variant protein? |
|---|---|---|
| 197 | yes | 197 |
| 466 | no | |
| 360 | no | |
| 288 | no | |
| 665 | no | |
| 560 | no | |
| 650 | no | |
| 480 | no | |
| 104 | yes | 104 |
| 580 | no | |
| 204 | yes | 204 |
| 115 | yes | 115 |
| 208 | yes | 208 |
| 152 | yes | 152 |
| 309 | no | |
| 432 | no | |
| 351 | no | |
| 246 | no | |
| 182 | yes | 182 |
| 612 | no | |
| 256 | no | |
| 508 | no | |
| 330 | no | |
| 274 | no | |
| 292 | no | |
| 553 | no | |
| 529 | no | |
| 375 | no | |

Variant protein HUMCEA_PEA_1_P4 (SEQ ID NO: 550) is encoded by the following transcript(s): HUMCEA_PEA_1_T8 (SEQ ID NO: 502), for which the sequence(s) is/are given at the end of the application. The coding portion of transcript HUMCEA_PEA_1_T8 (SEQ ID NO: 502) is shown in bold; this coding portion starts at position 115 and ends at position 1059. The transcript also has the following SNPs as listed in Table 10 (given according to their position on the nucleotide sequence, with the alternative nucleic acid listed; the last column indicates whether the SNP is known or not; the presence of known SNPs in variant protein HUMCEA_PEA_1_P4 (SEQ ID NO: 550) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 49 | T -> | No |
| 273 | A -> C | Yes |
| 303 | T -> G | No |
| 324 | T -> C | Yes |
| 352 | A -> G | Yes |
| 362 | T -> C | Yes |
| 524 | A -> C | Yes |
| 631 | G -> A | No |
| 1315 | A -> G | No |
| 1380 | T -> C | No |
| 1533 | C -> A | Yes |
| 1706 | G -> A | Yes |
| 2308 | T -> C | No |
| 2362 | C -> T | No |
| 2455 | A -> | No |
| 2504 | C -> A | Yes |
| 2558 | G -> | No |
| 2623 | G -> | No |
| 2639 | T -> A | No |
| 2640 | T -> A | No |
| 2832 | G -> A | Yes |
| 2885 | C -> T | No |
| 3396 | A -> G | Yes |
| 3562 | C -> T | Yes |
| 3753 | C -> T | Yes |

Variant protein HUMCEA_PEA_1_P5 (SEQ ID NO: 551) according to the present invention has an amino acid sequence as given at the end of the application; it is encoded by transcript(s) HUMCEA_PEA_1_T9 (SEQ ID NO: 503). An alignment is given to the known protein (Carcinoembryonic antigen-related cell adhesion molecule 5 precursor) at the end of the application. One or more alignments to one or more previously published protein sequences are given at the end of the application. A brief description of the relationship of the variant protein according to the present invention to each such aligned protein is as follows:

Comparison report between HUMCEA_PEA_1_P5 (SEQ ID NO: 551) and CEA5_HUMAN:

1. An isolated chimeric polypeptide encoding for HUMCEA_PEA_1_P5 (SEQ ID NO: 551), comprising a first amino acid sequence being at least 90% homologous to MESPSAPPHRWCIPWQRLLLTASLLTF-WNPPTTAKLTIESTPFNVAEGKEVLLLVHNLPQ HLF-GYSWYKGERVDGNRQIIGYVIGTQQAT-PGPAYSGREIIYPNASLLIQNIIQNDTGFYT LHVIKSDLVNEEATGQFRVYPELPKP-SISSNNSKPVEDKDAVAFTCEPETQDATYLWWV NNQSLPVSPRLQLSNGNRTLTLFN-VTRNDTASYKCETQNPVSARRSDSVILNVLYGPDA PTISPLNTSYRSGENLNLSCHAASNP-PAQYSWFVNGTFQQSTQELFIPNITVNNSGSYTC QAHNSDTGLNRTTVTTITVYAEPPK-PFITSNNSNPVEDEDAVALTCEPEIQNTTYLWWV NNQSLPVSPRLQLSNDNRTLTLLS-VTRNDVGPYECGIQNELSVDHSDPVILNVLYGPDD PTISPSYTYYRPGVNLSLSCHAASNP-PAQYSWLIDGNIQQHTQELFISNITEKNSGLYTCQ ANNSASGHSRTTVKTITVSAELPKP-SISSNNSKPVEDKDAVAFTCEPEAQNTTYLWWVN GQSLPVSPRLQLSNGNRTLTLFNVTRN-DARAYVCGIQNSVSANRSDPVTLDVLYGPDTP IISPP-DSSYLSGANLNLSCHSAS-NPSPQYSWRINGIPQQHTQVLFIAKITPNNNGTYACFV SNLATGRNNSIVKSITVS corresponding to amino acids 1-675 of CEA5_HUMAN, which also corresponds to amino acids 1-675 of HUMCEA_PEA_1_P5 (SEQ ID NO: 551), and a second amino acid sequence being at least 70%, optionally at least 80%, preferably at least 85%, more preferably at least 90% and most preferably at least 95% homologous to a polypeptide having the sequence GKWLPGASASYS-GVESIWFSPKSQEDIFFPSLCSMGTRKSQILS (SEQ ID NO: 1146) corresponding to amino acids 676-719 of HUMCEA_PEA_1_P5 (SEQ ID NO: 551), wherein said first amino acid sequence and second amino acid sequence are contiguous and in a sequential order.

2. An isolated polypeptide encoding for a tail of HUMCEA_PEA_1_P5 (SEQ ID NO: 551), comprising a polypeptide being at least 70%, optionally at least about 80%, preferably at least about 85%, more preferably at least about 90% and most preferably at least about 95% homologous to the sequence GKWLPGASASYSGVESIWFSPKSQEDIF-FPSLCSMGTRKSQILS (SEQ ID NO: 1146) in HUMCEA_PEA_1_P5 (SEQ ID NO: 551).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCEA_PEA_1_P5 (SEQ ID NO: 551) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein HUMCEA_PEA_1_P5 (SEQ ID NO: 551) sequence provides support for the deduced sequence of this variant protein according to the present invention).

TABLE 11

Amino acid mutations

| SNP position(s) on amino acid sequence | Alternative amino acid(s) | Previously known SNP? |
|---|---|---|
| 63 | F -> L | No |
| 80 | I -> V | Yes |
| 83 | V -> A | Yes |
| 137 | Q -> P | Yes |
| 173 | D -> N | No |
| 289 | I -> T | No |
| 340 | A -> D | Yes |
| 398 | E -> K | Yes |
| 647 | P -> | No |
| 664 | R -> S | Yes |

The glycosylation sites of variant protein HUMCEA_PEA_1_P5 (SEQ ID NO: 551), as compared to the known protein Carcinoembryonic antigen-related cell adhesion molecule 5 precursor, are described in Table 12 (given according to their position(s) on the amino acid sequence in the first column; the second column indicates whether the glycosylation site is present in the variant protein; and the last column indicates whether the position is different on the variant protein).

TABLE 12

Glycosylation site(s)

| Position(s) on known amino acid sequence | Present in variant protein? | Position in variant protein? |
|---|---|---|
| 197 | yes | 197 |
| 466 | yes | 466 |
| 360 | yes | 360 |
| 288 | yes | 288 |
| 665 | yes | 665 |
| 560 | yes | 560 |
| 650 | yes | 650 |
| 480 | yes | 480 |
| 104 | yes | 104 |
| 580 | yes | 580 |
| 204 | yes | 204 |
| 115 | yes | 115 |
| 208 | yes | 208 |
| 152 | yes | 152 |
| 309 | yes | 309 |
| 432 | yes | 432 |
| 351 | yes | 351 |
| 246 | yes | 246 |
| 182 | yes | 182 |
| 612 | yes | 612 |
| 256 | yes | 256 |
| 508 | yes | 508 |
| 330 | yes | 330 |
| 274 | yes | 274 |
| 292 | yes | 292 |
| 553 | yes | 553 |
| 529 | yes | 529 |
| 375 | yes | 375 |

Variant protein HUMCEA_PEA_1_P5 (SEQ ID NO: 551) is encoded by the following transcript(s): HUMCEA_PEA_1_T9 (SEQ ID NO: 503), for which the sequence(s) is/are given at the end of the application. The coding portion of transcript HUMCEA_PEA_1_T9 (SEQ ID NO: 503) is shown in bold; this coding portion starts at position 115 and ends at position 2271. The transcript also has the following SNPs as listed in Table 13 (given according to their position on the nucleotide sequence, with the alternative nucleic acid listed; the last column indicates whether the SNP is known or not; the presence of known SNPs in variant protein HUMCEA_PEA_1_P5 (SEQ ID NO: 551) sequence provides support for the deduced sequence of this variant protein according to the present invention).

TABLE 13

Nucleic acid SNPs

| SNP position on nucleotide sequence | Alternative nucleic acid | Previously known SNP? |
|---|---|---|
| 49 | T –> | No |
| 273 | A –> C | Yes |
| 303 | T –> G | No |
| 324 | T –> C | Yes |
| 352 | A –> G | Yes |
| 362 | T –> C | Yes |
| 524 | A –> C | Yes |
| 631 | G –> A | No |
| 915 | A –> G | No |
| 980 | T –> C | No |
| 1133 | C –> A | Yes |
| 1306 | G –> A | Yes |
| 1908 | T –> C | No |
| 1962 | C –> T | No |

TABLE 13-continued

Nucleic acid SNPs

| SNP position on nucleotide sequence | Alternative nucleic acid | Previously known SNP? |
|---|---|---|
| 2055 | A –> | No |
| 2104 | C –> A | Yes |
| 3259 | T –> C | Yes |

Variant protein HUMCEA_PEA_1_P14 (SEQ ID NO: 552) according to the present invention has an amino acid sequence as given at the end of the application; it is encoded by transcript(s) HUMCEA_PEA_1_T20 (SEQ ID NO: 504). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCEA_PEA_1_P14 (SEQ ID NO: 552) also has the following non-silent SNPs (Single Nucleotide Polymorphisms) as listed in Table 14, (given according to their position(s) on the amino acid sequence, with the alternative amino acid(s) listed; the last column indicates whether the SNP is known or not; the presence of known SNPs in variant protein HUMCEA_PEA_1_P14 (SEQ ID NO: 552) sequence provides support for the deduced sequence of this variant protein according to the present invention).

TABLE 14

Amino acid mutations

| SNP position(s) on amino acid sequence | Alternative amino acid(s) | Previously known SNP? |
|---|---|---|
| 63 | F –> L | No |
| 80 | I –> V | Yes |
| 83 | V –> A | Yes |
| 137 | Q –> P | Yes |
| 173 | D –> N | No |
| 289 | I –> T | No |
| 340 | A –> D | Yes |
| 398 | E –> K | Yes |

Variant protein HUMCEA_PEA_1_P14 (SEQ ID NO: 552) is encoded by the following transcript(s): HUMCEA_PEA_1_T20 (SEQ ID NO: 504), for which the sequence(s) is/are given at the end of the application. The coding portion of transcript HUMCEA_PEA_1_T20 (SEQ ID NO: 504) is shown in bold; this coding portion starts at position 115 and ends at position 1821. The transcript also has the following SNPs as listed in Table 15 (given according to their position on the nucleotide sequence, with the alternative nucleic acid listed; the last column indicates whether the SNP is known or not; the presence of known SNPs in variant protein HUMCEA_PEA_1_P14 (SEQ ID NO: 552) sequence provides support for the deduced sequence of this variant protein according to the present invention).

TABLE 15

Nucleic acid SNPs

| SNP position on nucleotide sequence | Alternative nucleic acid | Previously known SNP? |
|---|---|---|
| 49 | T –> | No |
| 273 | A –> C | Yes |
| 303 | T –> G | No |
| 324 | T –> C | Yes |
| 352 | A –> G | Yes |
| 362 | T –> C | Yes |
| 524 | A –> C | Yes |
| 631 | G –> A | No |
| 915 | A –> G | No |
| 980 | T –> C | No |
| 1133 | C –> A | Yes |
| 1306 | G –> A | Yes |

Variant protein HUMCEA_PEA_1_P19 (SEQ ID NO: 553) according to the present invention has an amino acid sequence as given at the end of the application; it is encoded by transcript(s) HUMCEA_PEA_1_T25 (SEQ ID NO: 505). An alignment is given to the known protein (Carcinoembryonic antigen-related cell adhesion molecule 5 precursor) at the end of the application. One or more alignments to one or more previously published protein sequences are given at the end of the application. A brief description of the relationship of the variant protein according to the present invention to each such aligned protein is as follows:

Comparison report between HUMCEA_PEA_1_P19 (SEQ ID NO: 553) and CEA5_HUMAN:

1. An isolated chimeric polypeptide encoding for HUMCEA_PEA_1_P19 (SEQ ID NO: 553), comprising a first amino acid sequence being at least 90% homologous to MESPSAPPHRWCIPWQRLLLTASLLTF-WNPPTTAKLTIESTPFNVAEGKEVLLLVHNLPQ HLF-GYSWYKGERVDGNRQIIGYVIGTQQAT-PGPAYSGREIIYPNASLLIQNIIQNDTGFYT LHVIKSDLVNEEATGQFRVYPELPKP-SISSNNSKPVEDKDAVAFTCEPETQDATYLWWV NNQSLPVSPRLQLSNGNRTLTLFN-VTRNDTASYKCETQNPVSARRSDSVILN corresponding to amino acids 1-232 of CEA5_HUMAN, which also corresponds to amino acids 1-232 of HUMCEA_PEA_1_P19 (SEQ ID NO: 553), and a second amino acid sequence being at least 90% homologous to VLYGPDTPIISPPDSSYLS-GANLNLSCHSASNPSPQYSWRING-IPQQHTQVLFIAKITPNNN GTYACFVSNLAT-GRNNSIVKSITVSASGTSPGLSAGATVGIMIGVLVGVALI corresponding to amino acids 589-702 of CEA5_HUMAN, which also corresponds to amino acids 233-346 of HUMCEA_PEA_1_P19 (SEQ ID NO: 553), wherein said first amino acid sequence and second amino acid sequence are contiguous and in a sequential order.

2. An isolated chimeric polypeptide encoding for an edge portion of HUMCEA_PEA_1_P19 (SEQ ID NO: 553), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NV, having a structure as follows: a sequence starting from any of amino acid numbers 232-x to 232; and ending at any of amino acid numbers 233+((n-2)-x), in which x varies from 0 to n-2.

The location of the variant protein was determined according to results from a number of different software programs and analyses, including analyses from SignalP and other specialized programs. The variant protein is believed to be located as follows with regard to the cell: membrane. The protein localization is believed to be membrane because of manual inspection of known protein localization and/or gene structure.

Variant protein HUMCEA_PEA_1_P19 (SEQ ID NO: 553) also has the following non-silent SNPs (Single Nucleotide Polymorphisms) as listed in Table 16, (given according to their position(s) on the amino acid sequence, with the alternative amino acid(s) listed; the last column indicates whether the SNP is known or not; the presence of known SNPs in variant protein HUMCEA_PEA_1_P19 (SEQ ID NO: 553) sequence provides support for the deduced sequence of this variant protein according to the present invention).

TABLE 16

Amino acid mutations

| SNP position(s) on amino acid sequence | Alternative amino acid(s) | Previously known SNP? |
|---|---|---|
| 63 | F –> L | No |
| 80 | I –> V | Yes |
| 83 | V –> A | Yes |
| 137 | Q –> P | Yes |
| 173 | D –> N | No |
| 291 | P –> | No |
| 308 | R –> S | Yes |
| 326 | G –> | No |

The glycosylation sites of variant protein HUMCEA_PEA_1_P19 (SEQ ID NO: 553), as compared to the known protein Carcinoembryonic antigen-related cell adhesion molecule 5 precursor, are described in Table 17 (given according to their position(s) on the amino acid sequence in the first column; the second column indicates whether the glycosylation site is present in the variant protein; and the last column indicates whether the position is different on the variant protein).

TABLE 17

Glycosylation site(s)

| Position(s) on known amino acid sequence | Present in variant protein? | Position in variant protein? |
|---|---|---|
| 197 | yes | 197 |
| 466 | no | |
| 360 | no | |
| 288 | no | |
| 665 | yes | 309 |
| 560 | no | |
| 650 | yes | 294 |
| 480 | no | |
| 104 | yes | 104 |
| 580 | no | |
| 204 | yes | 204 |
| 115 | yes | 115 |
| 208 | yes | 208 |
| 152 | yes | 152 |
| 309 | no | |
| 432 | no | |
| 351 | no | |
| 246 | no | |
| 182 | yes | 182 |
| 612 | yes | 256 |
| 256 | no | |
| 508 | no | |
| 330 | no | |
| 274 | no | |

TABLE 17-continued

Glycosylation site(s)

| Position(s) on known amino acid sequence | Present in variant protein? | Position in variant protein? |
|---|---|---|
| 292 | no | |
| 553 | no | |
| 529 | no | |
| 375 | no | |

Variant protein HUMCEA_PEA_1_P19 (SEQ ID NO: 553) is encoded by the following transcript(s): HUMCEA_PEA_1_T25 (SEQ ID NO: 505), for which the sequence(s) is/are given at the end of the application. The coding portion of transcript HUMCEA_PEA_1_T25 (SEQ ID NO: 505) is shown in bold; this coding portion starts at position 115 and ends at position 1152. The transcript also has the following SNPs as listed in Table 18 (given according to their position on the nucleotide sequence, with the alternative nucleic acid listed; the last column indicates whether the SNP is known or not; the presence of known SNPs in variant protein HUMCEA_PEA_1_P19 (SEQ ID NO: 553) sequence provides support for the deduced sequence of this variant protein according to the present invention).

TABLE 18

Nucleic acid SNPs

| SNP position on nucleotide sequence | Alternative nucleic acid | Previously known SNP? |
|---|---|---|
| 49 | T -> | No |
| 273 | A -> C | Yes |
| 303 | T -> G | No |
| 324 | T -> C | Yes |
| 352 | A -> G | Yes |
| 362 | T -> C | Yes |
| 524 | A -> C | Yes |
| 631 | G -> A | No |
| 840 | T -> C | No |
| 894 | C -> T | No |
| 987 | A -> | No |
| 1036 | C -> A | Yes |
| 1090 | G -> | No |
| 1155 | G -> | No |
| 1171 | T -> A | No |
| 1172 | T -> A | No |
| 1364 | G -> A | Yes |
| 1417 | C -> T | No |
| 1928 | A -> G | Yes |
| 2094 | C -> T | Yes |
| 2285 | C -> T | Yes |

Variant protein HUMCEA_PEA_1_P20 (SEQ ID NO: 554) according to the present invention has an amino acid sequence as given at the end of the application; it is encoded by transcript(s) HUMCEA_PEA_1_T26 (SEQ ID NO: 506). An alignment is given to the known protein (Carcinoembryonic antigen-related cell adhesion molecule 5 precursor) at the end of the application. One or more alignments to one or more previously published protein sequences are given at the end of the application. A brief description of the relationship of the variant protein according to the present invention to each such aligned protein is as follows:

Comparison report between HUMCEA_PEA_1_P20 (SEQ ID NO: 554) and CEA5_HUMAN:

1. An isolated chimeric polypeptide encoding for HUMCEA_PEA_1_P20 (SEQ ID NO: 554), comprising a first amino acid sequence being at least 90% homologous to MESPSAPPHRWCIPWQRLLLTASLLTF-WNPPTTAKLTIESTPFNVAEGKEVLLLVHNLPQ HLF-GYSWYKGERVDGNRQIIGYVIGTQQAT-PGPAYSGREIIYPNASLLIQNIIQNDTGFYT LHVIKSDLVNEEATGQFRVYP corresponding to amino acids 1-142 of CEA5_HUMAN, which also corresponds to amino acids 1-142 of HUMCEA_PEA_1_P20 (SEQ ID NO: 554), and a second amino acid sequence being at least 90% homologous to ELPKPSISSNNSKPVEDKDAVAFTCE-PEAQNTTYLWWVNGQSLPVSPRLQLSNGNRTLT LFNVTRNDARAYVCGIQNSVSANRSD-PVTLDVLYGPDTPIISPPDSSYLSGANLNLSCHS ASNPSPQYSWRINGIPQQHTQVLFIAK-ITPNNNGTYACFVSNLATGRNNSIVKSITVSASG TSPGLSAGATVGIMIGVLVGVALI corresponding to amino acids 499-702 of CEA5_HUMAN, which also corresponds to amino acids 143-346 of HUMCEA_PEA_1_P20 (SEQ ID NO: 554), wherein said first amino acid sequence and second amino acid sequence are contiguous and in a sequential order.

2. An isolated chimeric polypeptide encoding for an edge portion of HUMCEA_PEA_1_P20 (SEQ ID NO: 554), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PE, having a structure as follows: a sequence starting from any of amino acid numbers 142−x to 142; and ending at any of amino acid numbers 143+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because of manual inspection of known protein localization and/or gene structure.

Variant protein HUMCEA_PEA_1_P20 (SEQ ID NO: 554) also has the following non-silent SNPs (Single Nucleotide Polymorphisms) as listed in Table 19, (given according to their position(s) on the amino acid sequence, with the alternative amino acid(s) listed; the last column indicates whether the SNP is known or not; the presence of known SNPs in variant protein HUMCEA_PEA_1_P20 (SEQ ID NO: 554) sequence provides support for the deduced sequence of this variant protein according to the present invention).

TABLE 19

Amino acid mutations

| SNP position(s) on amino acid sequence | Alternative amino acid(s) | Previously known SNP? |
|---|---|---|
| 63 | F -> L | No |
| 80 | I -> V | Yes |
| 83 | V -> A | Yes |
| 137 | Q -> P | Yes |
| 291 | P -> | No |
| 308 | R -> S | Yes |
| 326 | G -> | No |

The glycosylation sites of variant protein HUMCEA_PEA_1_P20 (SEQ ID NO: 554), as compared to the known protein Carcinoembryonic antigen-related cell adhesion molecule 5 precursor, are described in Table 20 (given according to their position(s) on the amino acid sequence in the first column; the second column indicates whether the glycosylation site is present in the variant protein; and the last column indicates whether the position is different on the variant protein).

TABLE 20

Glycosylation site(s)

| Position(s) on known amino acid sequence | Present in variant protein? | Position in variant protein? |
|---|---|---|
| 197 | no | |
| 466 | no | |
| 360 | no | |
| 288 | no | |
| 665 | yes | 309 |
| 560 | yes | 204 |
| 650 | yes | 294 |
| 480 | no | |
| 104 | yes | 104 |
| 580 | yes | 224 |
| 204 | no | |
| 115 | yes | 115 |
| 208 | no | |
| 152 | no | |
| 309 | no | |
| 432 | no | |
| 351 | no | |
| 246 | no | |
| 182 | no | |
| 612 | yes | 256 |
| 256 | no | |
| 508 | yes | 152 |
| 330 | no | |
| 274 | no | |
| 292 | no | |
| 553 | yes | 197 |
| 529 | yes | 173 |
| 375 | no | |

Variant protein HUMCEA_PEA_1_P20 (SEQ ID NO: 554) is encoded by the following transcript(s): HUMCEA_PEA_1_T26 (SEQ ID NO: 506), for which the sequence(s) is/are given at the end of the application. The coding portion of transcript HUMCEA_PEA_1_T26 (SEQ ID NO: 506) is shown in bold; this coding portion starts at position 115 and ends at position 1152. The transcript also has the following SNPs as listed in Table 21 (given according to their position on the nucleotide sequence, with the alternative nucleic acid listed; the last column indicates whether the SNP is known or not; the presence of known SNPs in variant protein HUMCEA_PEA_1_P20 (SEQ ID NO: 554) sequence provides support for the deduced sequence of this variant protein according to the present invention).

TABLE 21

Nucleic acid SNPs

| SNP position on nucleotide sequence | Alternative nucleic acid | Previously known SNP? |
|---|---|---|
| 49 | T -> | No |
| 273 | A -> C | Yes |
| 303 | T -> G | No |
| 324 | T -> C | Yes |
| 352 | A -> G | Yes |
| 362 | T -> C | Yes |
| 524 | A -> C | Yes |
| 840 | T -> C | No |
| 894 | C -> T | No |
| 987 | A -> | No |
| 1036 | C -> A | Yes |
| 1090 | G -> | No |

TABLE 21-continued

Nucleic acid SNPs

| SNP position on nucleotide sequence | Alternative nucleic acid | Previously known SNP? |
|---|---|---|
| 1155 | G -> | No |
| 1171 | T -> A | No |
| 1172 | T -> A | No |
| 1364 | G -> A | Yes |
| 1417 | C -> T | No |
| 1928 | A -> G | Yes |
| 2094 | C -> T | Yes |
| 2285 | C -> T | Yes |

As noted above, cluster HUMCEA features 42 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMCEA_PEA_1_node_0 (SEQ ID NO: 507) according to the present invention is supported by 56 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503), HUMCEA_PEA_1_T20 (SEQ ID NO: 504), HUMCEA_PEA_1_T25 (SEQ ID NO: 505) and HUMCEA_PEA_1_T26 (SEQ ID NO: 506). Table 22 below describes the starting and ending position of this segment on each transcript.

TABLE 22

Segment location on transcripts

| Tanscript name | Segment starting position | Segment ending position |
|---|---|---|
| HUMCEA_PEA_1_T8 (SEQ ID NO:502) | 1 | 178 |
| HUMCEA_PEA_1_T9 (SEQ ID NO:503) | 1 | 178 |
| HUMCEA_PEA_1_T20 (SEQ ID NO:504) | 1 | 178 |
| HUMCEA_PEA_1_T25 (SEQ ID NO:505) | 1 | 178 |
| HUMCEA_PEA_1_T26 (SEQ ID NO:506) | 1 | 178 |

Segment cluster HUMCEA_PEA_1_node_2 (SEQ ID NO: 508) according to the present invention is supported by 83 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503), HUMCEA_PEA_1_T20 (SEQ ID NO: 504), HUMCEA_PEA_1_T25 (SEQ ID NO: 505) and HUMCEA_PEA_1_T26 (SEQ ID NO: 506). Table 23 below describes the starting and ending position of this segment on each transcript.

TABLE 23

Segment location on transcripts

| Tanscript name | Segment starting position | Segment ending position |
|---|---|---|
| HUMCEA_PEA_1_T8 (SEQ ID NO:502) | 179 | 456 |
| HUMCEA_PEA_1_T9 (SEQ ID NO:503) | 179 | 456 |
| HUMCEA_PEA_1_T20 (SEQ ID NO:504) | 179 | 456 |
| HUMCEA_PEA_1_T25 (SEQ ID NO:505) | 179 | 456 |
| HUMCEA_PEA_1_T26 (SEQ ID NO:506) | 179 | 456 |

Segment cluster HUMCEA_PEA_1_node_11 (SEQ ID NO: 509) according to the present invention is supported by 6 libraries. The number of libraries was determined as previously described. This segment can be found in the following transcript(s): HUMCEA_PEA_1_T8 (SEQ ID NO: 502). Table 24 below describes the starting and ending position of this segment on each transcript.

TABLE 24

Segment location on transcripts

| Tanscript name | Segment starting position | Segment ending position |
|---|---|---|
| HUMCEA_PEA_1_T8 (SEQ ID NO:502) | 818 | 1217 |

Segment cluster HUMCEA_PEA_1_node_12 (SEQ ID NO: 510) according to the present invention is supported by 83 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503) and HUMCEA_PEA_1_T20 (SEQ ID NO: 504). Table 26 below describes the starting and ending position of this segment on each transcript.

TABLE 26

Segment location on transcripts

| Tanscript name | Segment starting position | Segment ending position |
|---|---|---|
| HUMCEA_PEA_1_T8 (SEQ ID NO:502) | 1218 | 1472 |
| HUMCEA_PEA_1_T9 (SEQ ID NO:503) | 818 | 1072 |
| HUMCEA_PEA_1_T20 (SEQ ID NO:504) | 818 | 1072 |

Segment cluster HUMCEA_PEA_1_node_31 (SEQ ID NO: 511) according to the present invention is supported by 87 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503) and HUMCEA_PEA_1_T20 (SEQ ID NO: 504). Table 27 below describes the starting and ending position of this segment on each transcript.

TABLE 27

Segment location on transcripts

| Tanscript name | Segment starting position | Segment ending position |
|---|---|---|
| HUMCEA_PEA_1_T8 (SEQ ID NO:502) | 1817 | 2006 |
| HUMCEA_PEA_1_T9 (SEQ ID NO:503) | 1417 | 1606 |
| HUMCEA_PEA_1_T20 (SEQ ID NO:504) | 1417 | 1606 |

Segment cluster HUMCEA_PEA_1_node_36 (SEQ ID NO: 512) according to the present invention is supported by 94 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503) and HUMCEA_PEA_1_T26 (SEQ ID NO: 506). Table 28 below describes the starting and ending position of this segment on each transcript.

TABLE 28

Segment location on transcripts

| Tanscript name | Segment starting position | Segment ending position |
|---|---|---|
| HUMCEA_PEA_1_T8 (SEQ ID NO:502) | 2159 | 2285 |
| HUMCEA_PEA_1_T9 (SEQ ID NO:503) | 1759 | 1885 |
| HUMCEA_PEA_1_T26 (SEQ ID NO:506) | 691 | 817 |

Segment cluster HUMCEA_PEA_1_node_44 (SEQ ID NO: 513) according to the present invention is supported by 112 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503), HUMCEA_PEA_1_T25 (SEQ ID NO: 505) and HUMCEA_PEA_1_T26 (SEQ ID NO: 506). Table 29 below describes the starting and ending position of this segment on each transcript.

TABLE 29

Segment location on transcripts

| Tanscript name | Segment starting position | Segment ending position |
|---|---|---|
| HUMCEA_PEA_1_T8 (SEQ ID NO:502) | 2286 | 2540 |
| HUMCEA_PEA_1_T9 (SEQ ID NO:503) | 1886 | 2140 |
| HUMCEA_PEA_1_T25 (SEQ ID NO:505) | 818 | 1072 |
| HUMCEA_PEA_1_T26 (SEQ ID NO:506) | 818 | 1072 |

Segment cluster HUMCEA_PEA_1_node_46 (SEQ ID NO: 514) according to the present invention is supported by 15 libraries. The number of libraries was determined as previously described. This segment can be found in the following transcript(s): HUMCEA_PEA_1_T9 (SEQ ID NO: 503). Table 30 below describes the starting and ending position of this segment on each transcript.

TABLE 30

Segment location on transcripts

| Tanscript name | Segment starting position | Segment ending position |
|---|---|---|
| HUMCEA_PEA_1_T9 (SEQ ID NO:503) | 2174 | 3347 |

Segment cluster HUMCEA_PEA_1_node_63 (SEQ ID NO: 515) according to the present invention is supported by 68 libraries. The number of libraries was determined as previously described. This segment can be found in the following transcript(s): HUMCEA_PEA_1_T8 (SEQ ID NO: 502), HUMCEA_PEA_1_T25 (SEQ ID NO: 505) and HUMCEA_PEA_1_T26 (SEQ ID NO: 506). Table 31 below describes the starting and ending position of this segment on each transcript.

TABLE 31

Segment location on transcripts

| Tanscript name | Segment starting position | Segment ending position |
|---|---|---|
| HUMCEA_PEA_1_T8 (SEQ ID NO:502) | 2957 | 3135 |
| HUMCEA_PEA_1_T25 (SEQ ID NO:505) | 1489 | 1667 |
| HUMCEA_PEA_1_T26 (SEQ ID NO:506) | 1489 | 1667 |

Segment cluster HUMCEA_PEA_1_node_65 (SEQ ID NO: 516) according to the present invention is supported by 54 libraries. The number of libraries was determined as previously described. This segment can be found in the following transcript(s): HUMCEA_PEA_1_T8 (SEQ ID NO: 502), HUMCEA_PEA_1_T25 (SEQ ID NO: 505) and HUMCEA_PEA_1_T26 (SEQ ID NO: 506). Table 32 below describes the starting and ending position of this segment on each transcript.

TABLE 32

Segment location on transcripts

| Tanscript name | Segment starting position | Segment ending position |
|---|---|---|
| HUMCEA_PEA_1_T8 (SEQ ID NO:502) | 3166 | 3897 |
| HUMCEA_PEA_1_T25 (SEQ ID NO:505) | 1698 | 2429 |
| HUMCEA_PEA_1_T26 (SEQ ID NO:506) | 1698 | 2429 |

Segment cluster HUMCEA_PEA_1_node_67 (SEQ ID NO: 517) according to the present invention is supported by 2 libraries. The number of libraries was determined as previously described. This segment can be found in the following transcript(s): HUMCEA_PEA_1_T20 (SEQ ID NO: 504). Table 33 below describes the starting and ending position of this segment on each transcript.

TABLE 33

Segment location on transcripts

| Tanscript name | Segment starting position | Segment ending position |
|---|---|---|
| HUMCEA_PEA_1_T20 (SEQ ID NO:504) | 1607 | 1886 |

According to an optional embodiment of the present invention, short segments related to the above cluster are also provided. These segments are up to about 120 bp in length, and so are included in a separate description.

Segment cluster HUMCEA_PEA_1_node_3 (SEQ ID NO: 518) according to the present invention is supported by 67 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503), HUMCEA_PEA_1_T20 (SEQ ID NO: 504), HUMCEA_PEA_1_T25 (SEQ ID NO: 505) and HUMCEA_PEA_1_T26 (SEQ ID NO: 506). Table 34 below describes the starting and ending position of this segment on each transcript.

TABLE 34

Segment location on transcripts

| Transcript name | Segment starting position | Segment ending position |
|---|---|---|
| HUMCEA_PEA_1_T8 (SEQ ID NO: 502) | 457 | 538 |
| HUMCEA_PEA_1_T9 (SEQ ID NO: 503) | 457 | 538 |
| HUMCEA_PEA_1_T20 (SEQ ID NO: 504) | 457 | 538 |
| HUMCEA_PEA_1_T25 (SEQ ID NO: 505) | 457 | 538 |
| HUMCEA_PEA_1_T26 (SEQ ID NO: 506) | 457 | 538 |

Segment cluster HUMCEA_PEA_1_node_7 (SEQ ID NO: 519) according to the present invention is supported by 73 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503), HUMCEA_PEA_1_T20 (SEQ ID NO: 504) and HUMCEA_PEA_1_T25 (SEQ ID NO: 505). Table 35 below describes the starting and ending position of this segment on each transcript.

TABLE 35

Segment location on transcripts

| Transcript name | Segment starting position | Segment ending position |
|---|---|---|
| HUMCEA_PEA_1_T8 (SEQ ID NO: 502) | 539 | 642 |
| HUMCEA_PEA_1_T9 (SEQ ID NO: 503) | 539 | 642 |
| HUMCEA_PEA_1_T20 (SEQ ID NO: 504) | 539 | 642 |
| HUMCEA_PEA_1_T25 (SEQ ID NO: 505) | 539 | 642 |

Segment cluster HUMCEA_PEA_1_node_8 (SEQ ID NO: 520) according to the present invention is supported by 67 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503), HUMCEA_PEA_1_T20 (SEQ ID NO: 504) and HUMCEA_PEA_1_T25 (SEQ ID NO: 505). Table 36 below describes the starting and ending position of this segment on each transcript.

TABLE 36

Segment location on transcripts

| Transcript name | Segment starting position | Segment ending position |
|---|---|---|
| HUMCEA_PEA_1_T8 (SEQ ID NO: 502) | 643 | 690 |
| HUMCEA_PEA_1_T9 (SEQ ID NO: 503) | 643 | 690 |
| HUMCEA_PEA_1_T20 (SEQ ID NO: 504) | 643 | 690 |
| HUMCEA_PEA_1_T25 (SEQ ID NO: 505) | 643 | 690 |

Segment cluster HUMCEA_PEA_1_node_9 (SEQ ID NO: 521) according to the present invention is supported by 71 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503), HUMCEA_PEA_1_T20 (SEQ ID NO: 504) and HUMCEA_PEA_1_T25 (SEQ ID NO: 505). Table 37 below describes the starting and ending position of this segment on each transcript.

TABLE 37

Segment location on transcripts

| Transcript name | Segment starting position | Segment ending position |
|---|---|---|
| HUMCEA_PEA_1_T8 (SEQ ID NO: 502) | 691 | 738 |
| HUMCEA_PEA_1_T9 (SEQ ID NO: 503) | 691 | 738 |
| HUMCEA_PEA_1_T20 (SEQ ID NO: 504) | 691 | 738 |
| HUMCEA_PEA_1_T25 (SEQ ID NO: 505) | 691 | 738 |

Segment cluster HUMCEA_PEA_1_node_10 (SEQ ID NO: 522) according to the present invention is supported by 67 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503), HUMCEA_PEA_1_T20 (SEQ ID NO: 504) and HUMCEA_PEA_1_T25 (SEQ ID NO: 505). Table 38 below describes the starting and ending position of this segment on each transcript.

TABLE 38

Segment location on transcripts

| Transcript name | Segment starting position | Segment ending position |
|---|---|---|
| HUMCEA_PEA_1_T8 (SEQ ID NO: 502) | 739 | 817 |
| HUMCEA_PEA_1_T9 (SEQ ID NO: 503) | 739 | 817 |
| HUMCEA_PEA_1_T20 (SEQ ID NO: 504) | 739 | 817 |
| HUMCEA_PEA_1_T25 (SEQ ID NO: 505) | 739 | 817 |

Segment cluster HUMCEA_PEA_1_node_15 (SEQ ID NO: 523) according to the present invention can be found in the following transcript(s): HUMCEA_PEA_1_T8 (SEQ ID NO: 502), HUMCEA_PEA_1_T9 (SEQ ID NO: 503) and HUMCEA_PEA_1_T20 (SEQ ID NO: 504). Table 39 below describes the starting and ending position of this segment on each transcript.

TABLE 39

Segment location on transcripts

| Transcript name | Segment starting position | Segment ending position |
|---|---|---|
| HUMCEA_PEA_1_T8 (SEQ ID NO: 502) | 1473 | 1475 |
| HUMCEA_PEA_1_T9 (SEQ ID NO: 503) | 1073 | 1075 |
| HUMCEA_PEA_1_T20 (SEQ ID NO: 504) | 1073 | 1075 |

Segment cluster HUMCEA_PEA_1_node_16 (SEQ ID NO: 524) according to the present invention can be found in the following transcript(s): HUMCEA_PEA_1_T8 (SEQ ID NO: 502), HUMCEA_PEA_1_T9 (SEQ ID NO: 503) and HUMCEA_PEA_1_T20 (SEQ ID NO: 504). Table 40 below describes the starting and ending position of this segment on each transcript.

TABLE 40

Segment location on transcripts

| Transcript name | Segment starting position | Segment ending position |
|---|---|---|
| HUMCEA_PEA_1_T8 (SEQ ID NO: 502) | 1476 | 1481 |
| HUMCEA_PEA_1_T9 (SEQ ID NO: 503) | 1076 | 1081 |
| HUMCEA_PEA_1_T20 (SEQ ID NO: 504) | 1076 | 1081 |

Segment cluster HUMCEA_PEA_1_node_17 (SEQ ID NO: 525) according to the present invention can be found in the following transcript(s): HUMCEA_PEA_1_T8 (SEQ ID NO: 502), HUMCEA_PEA_1_T9 (SEQ ID NO: 503) and HUMCEA_PEA_1_T20 (SEQ ID NO: 504). Table 41 below describes the starting and ending position of this segment on each transcript.

TABLE 41

Segment location on transcripts

| Transcript name | Segment starting position | Segment ending position |
|---|---|---|
| HUMCEA_PEA_1_T8 (SEQ ID NO: 502) | 1482 | 1488 |
| HUMCEA_PEA_1_T9 (SEQ ID NO: 503) | 1082 | 1088 |
| HUMCEA_PEA_1_T20 (SEQ ID NO: 504) | 1082 | 1088 |

Segment cluster HUMCEA_PEA_1_node_18 (SEQ ID NO: 526) according to the present invention can be found in the following transcript(s): HUMCEA_PEA_1_T8 (SEQ ID NO: 502), HUMCEA_PEA_1_T9 (SEQ ID NO: 503) and HUMCEA_PEA_1_T20 (SEQ ID NO: 504). Table 42 below describes the starting and ending position of this segment on each transcript.

TABLE 42

Segment location on transcripts

| Transcript name | Segment starting position | Segment ending position |
|---|---|---|
| HUMCEA_PEA_1_T8 (SEQ ID NO: 502) | 1489 | 1506 |
| HUMCEA_PEA_1_T9 (SEQ ID NO: 503) | 1089 | 1106 |
| HUMCEA_PEA_1_T20 (SEQ ID NO: 504) | 1089 | 1106 |

Segment cluster HUMCEA_PEA_1_node_19 (SEQ ID NO: 527) according to the present invention is supported by 69 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503) and HUMCEA_PEA_1_T20 (SEQ ID NO: 504). Table 43 below describes the starting and ending position of this segment on each transcript.

TABLE 43

Segment location on transcripts

| Transcript name | Segment starting position | Segment ending position |
|---|---|---|
| HUMCEA_PEA_1_T8 (SEQ ID NO: 502) | 1507 | 1576 |
| HUMCEA_PEA_1_T9 (SEQ ID NO: 503) | 1107 | 1176 |
| HUMCEA_PEA_1_T20 (SEQ ID NO: 504) | 1107 | 1176 |

Segment cluster HUMCEA_PEA_1_node_20 (SEQ ID NO: 528) according to the present invention can be found in the following transcript(s): HUMCEA_PEA_1_T8 (SEQ ID NO: 502), HUMCEA_PEA_1_T9 (SEQ ID NO: 503) and HUMCEA_PEA_1_T20 (SEQ ID NO: 504). Table 44 below describes the starting and ending position of this segment on each transcript.

TABLE 44

Segment location on transcripts

| Transcript name | Segment starting position | Segment ending position |
|---|---|---|
| HUMCEA_PEA_1_T8 (SEQ ID NO: 502) | 1577 | 1600 |
| HUMCEA_PEA_1_T9 (SEQ ID NO: 503) | 1177 | 1200 |
| HUMCEA_PEA_1_T20 (SEQ ID NO: 504) | 1177 | 1200 |

Segment cluster HUMCEA_PEA_1_node_21 (SEQ ID NO: 529) according to the present invention can be found in the following transcript(s): HUMCEA_PEA_1_T8 (SEQ ID NO: 502), HUMCEA_PEA_1_T9 (SEQ ID NO: 503) and HUMCEA_PEA_1_T20 (SEQ ID NO: 504). Table 45 below describes the starting and ending position of this segment on each transcript.

TABLE 45

Segment location on transcripts

| Transcript name | Segment starting position | Segment ending position |
|---|---|---|
| HUMCEA_PEA_1_T8 (SEQ ID NO: 502) | 1601 | 1624 |
| HUMCEA_PEA_1_T9 (SEQ ID NO: 503) | 1201 | 1224 |
| HUMCEA_PEA_1_T20 (SEQ ID NO: 504) | 1201 | 1224 |

Segment cluster HUMCEA_PEA_1_node_22 (SEQ ID NO: 530) according to the present invention is supported by 77 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503) and HUMCEA_PEA_1_T20 (SEQ ID NO: 504). Table 46 below describes the starting and ending position of this segment on each transcript.

TABLE 46

Segment location on transcripts

| Transcript name | Segment starting position | Segment ending position |
|---|---|---|
| HUMCEA_PEA_1_T8 (SEQ ID NO: 502) | 1625 | 1702 |
| HUMCEA_PEA_1_T9 (SEQ ID NO: 503) | 1225 | 1302 |
| HUMCEA_PEA_1_T20 (SEQ ID NO: 504) | 1225 | 1302 |

Segment cluster HUMCEA_PEA_1_node_23 (SEQ ID NO: 531) according to the present invention is supported by 72 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503) and HUMCEA_PEA_1_T20 (SEQ ID NO: 504). Table 47 below describes the starting and ending position of this segment on each transcript.

TABLE 47

Segment location on transcripts

| Transcript name | Segment starting position | Segment ending position |
|---|---|---|
| HUMCEA_PEA_1_T8 (SEQ ID NO: 502) | 1703 | 1732 |
| HUMCEA_PEA_1_T9 (SEQ ID NO: 503) | 1303 | 1332 |
| HUMCEA_PEA_1_T20 (SEQ ID NO: 504) | 1303 | 1332 |

Segment cluster HUMCEA_PEA_1_node_24 (SEQ ID NO: 532) according to the present invention can be found in the following transcript(s): HUMCEA_PEA_1_T8 (SEQ ID NO: 502), HUMCEA_PEA_1_T9 (SEQ ID NO: 503) and HUMCEA_PEA_1_T20 (SEQ ID NO: 504). Table 48 below describes the starting and ending position of this segment on each transcript.

TABLE 48

Segment location on transcripts

| Transcript name | Segment starting position | Segment ending position |
|---|---|---|
| HUMCEA_PEA_1_T8 (SEQ ID NO: 502) | 1733 | 1751 |
| HUMCEA_PEA_1_T9 (SEQ ID NO: 503) | 1333 | 1351 |
| HUMCEA_PEA_1_T20 (SEQ ID NO: 504) | 1333 | 1351 |

Segment cluster HUMCEA_PEA_1_node_27 (SEQ ID NO: 533) according to the present invention can be found in the following transcript(s): HUMCEA_PEA_1_T8 (SEQ ID NO: 502), HUMCEA_PEA_1_T9 (SEQ ID NO: 503) and HUMCEA_PEA_1_T20 (SEQ ID NO: 504). Table 49 below describes the starting and ending position of this segment on each transcript.

TABLE 49

Segment location on transcripts

| Transcript name | Segment starting position | Segment ending position |
|---|---|---|
| HUMCEA_PEA_1_T8 (SEQ ID NO: 502) | 1752 | 1770 |
| HUMCEA_PEA_1_T9 (SEQ ID NO: 503) | 1352 | 1370 |
| HUMCEA_PEA_1_T20 (SEQ ID NO: 504) | 1352 | 1370 |

Segment cluster HUMCEA_PEA_1_node_29 (SEQ ID NO: 534) according to the present invention can be found in the following transcript(s): HUMCEA_PEA_1_T8 (SEQ ID NO: 502), HUMCEA_PEA_1_T9 (SEQ ID NO: 503) and HUMCEA_PEA_1_T20 (SEQ ID NO: 504). Table 50 below describes the starting and ending position of this segment on each transcript.

TABLE 50

Segment location on transcripts

| Transcript name | Segment starting position | Segment ending position |
|---|---|---|
| HUMCEA_PEA_1_T8 (SEQ ID NO: 502) | 1771 | 1788 |
| HUMCEA_PEA_1_T9 (SEQ ID NO: 503) | 1371 | 1388 |
| HUMCEA_PEA_1_T20 (SEQ ID NO: 504) | 1371 | 1388 |

Segment cluster HUMCEA_PEA_1_node_30 (SEQ ID NO: 535) according to the present invention is supported by 67 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503) and HUMCEA_PEA_1_T20 (SEQ ID NO: 504). Table 51 below describes the starting and ending position of this segment on each transcript.

TABLE 51

Segment location on transcripts

| Transcript name | Segment starting position | Segment ending position |
|---|---|---|
| HUMCEA_PEA_1_T8 (SEQ ID NO: 502) | 1789 | 1816 |
| HUMCEA_PEA_1_T9 (SEQ ID NO: 503) | 1389 | 1416 |
| HUMCEA_PEA_1_T20 (SEQ ID NO: 504) | 1389 | 1416 |

Segment cluster HUMCEA_PEA_1_node_33 (SEQ ID NO: 536) according to the present invention can be found in the following transcript(s): HUMCEA_PEA_1_T8 (SEQ ID NO: 502), HUMCEA_PEA_1_T9 (SEQ ID NO: 503) and HUMCEA_PEA_1_T26 (SEQ ID NO: 506). Table 52 below describes the starting and ending position of this segment on each transcript.

TABLE 52

Segment location on transcripts

| Transcript name | Segment starting position | Segment ending position |
|---|---|---|
| HUMCEA_PEA_1_T8 (SEQ ID NO: 502) | 2007 | 2028 |
| HUMCEA_PEA_1_T9 (SEQ ID NO: 503) | 1607 | 1628 |
| HUMCEA_PEA_1_T26 (SEQ ID NO: 506) | 539 | 560 |

Segment cluster HUMCEA_PEA_1_node_34 (SEQ ID NO: 537) according to the present invention is supported by 80 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503) and HUMCEA_PEA_1_T26 (SEQ ID NO: 506). Table 53 below describes the starting and ending position of this segment on each transcript.

TABLE 53

Segment location on transcripts

| Transcript name | Segment starting position | Segment ending position |
|---|---|---|
| HUMCEA_PEA_1_T8 (SEQ ID NO: 502) | 2029 | 2110 |
| HUMCEA_PEA_1_T9 (SEQ ID NO: 503) | 1629 | 1710 |
| HUMCEA_PEA_1_T26 (SEQ ID NO: 506) | 561 | 642 |

Segment cluster HUMCEA_PEA_1_node_35 (SEQ ID NO: 538) according to the present invention is supported by 75 libraries. The number of libraries was determined as previously described. This segment can be found in the following transcript(s): HUMCEA_PEA_1_T8 (SEQ ID NO: 502), HUMCEA_PEA_1_T9 (SEQ ID NO: 503) and HUMCEA_PEA_1_T26 (SEQ ID NO: 506). Table 54 below describes the starting and ending position of this segment on each transcript.

TABLE 54

Segment location on transcripts

| Transcript name | Segment starting position | Segment ending position |
|---|---|---|
| HUMCEA_PEA_1_T8 (SEQ ID NO: 502) | 2111 | 2158 |
| HUMCEA_PEA_1_T9 (SEQ ID NO: 503) | 1711 | 1758 |
| HUMCEA_PEA_1_T26 (SEQ ID NO: 506) | 643 | 690 |

Segment cluster HUMCEA_PEA_1_node_45 (SEQ ID NO: 539) according to the present invention is supported by 9 libraries. The number of libraries was determined as previously described. This segment can be found in the following transcript(s): HUMCEA_PEA_1_T9 (SEQ ID NO: 503). Table 55 below describes the starting and ending position of this segment on each transcript.

TABLE 55

Segment location on transcripts

| Transcript name | Segment starting position | Segment ending position |
|---|---|---|
| HUMCEA_PEA_1_T9 (SEQ ID NO: 503) | 2141 | 2173 |

Segment cluster HUMCEA_PEA_1_node_50 (SEQ ID NO: 540) according to the present invention is supported by 64 libraries. The number of libraries was determined as previously described. This segment can be found in the following transcript(s): HUMCEA_PEA_1_T8 (SEQ ID NO: 502), HUMCEA_PEA_1_T25 (SEQ ID NO: 505) and HUMCEA_PEA_1_T26 (SEQ ID NO: 506). Table 56 below describes the starting and ending position of this segment on each transcript.

TABLE 56

Segment location on transcripts

| Transcript name | Segment starting position | Segment ending position |
|---|---|---|
| HUMCEA_PEA_1_T8 (SEQ ID NO: 502) | 2541 | 2567 |
| HUMCEA_PEA_1_T25 (SEQ ID NO: 505) | 1073 | 1099 |
| HUMCEA_PEA_1_T26 (SEQ ID NO: 506) | 1073 | 1099 |

Segment cluster HUMCEA_PEA_1_node_51 (SEQ ID NO: 541) according to the present invention is supported by 88 libraries. The number of libraries was determined as previously described. This segment can be found in the following transcript(s): HUMCEA_PEA_1_T8 (SEQ ID NO: 502), HUMCEA_PEA_1_T25 (SEQ ID NO: 505) and HUMCEA_PEA_1_T26 (SEQ ID NO: 506). Table 57 below describes the starting and ending position of this segment on each transcript.

TABLE 57

Segment location on transcripts

| Transcript name | Segment starting position | Segment ending position |
|---|---|---|
| HUMCEA_PEA_1_T8 (SEQ ID NO: 502) | 2568 | 2659 |
| HUMCEA_PEA_1_T25 (SEQ ID NO: 505) | 1100 | 1191 |
| HUMCEA_PEA_1_T26 (SEQ ID NO: 506) | 1100 | 1191 |

Segment cluster HUMCEA_PEA_1_node_56 (SEQ ID NO: 542) according to the present invention is supported by 75 libraries. The number of libraries was determined as previously described. This segment can be found in the following transcript(s): HUMCEA_PEA_1_T8 (SEQ ID NO: 502), HUMCEA_PEA_1_T25 (SEQ ID NO: 505) and HUMCEA_PEA_1_T26 (SEQ ID NO: 506). Table 58 below describes the starting and ending position of this segment on each transcript.

TABLE 58

Segment location on transcripts

| Transcript name | Segment starting position | Segment ending position |
|---|---|---|
| HUMCEA_PEA_1_T8 (SEQ ID NO: 502) | 2660 | 2685 |
| HUMCEA_PEA_1_T25 (SEQ ID NO: 505) | 1192 | 1217 |
| HUMCEA_PEA_1_T26 (SEQ ID NO: 506) | 1192 | 1217 |

Segment cluster HUMCEA_PEA_1_node_57 (SEQ ID NO: 543) according to the present invention is supported by 82 libraries. The number of libraries was determined as previously described. This segment can be found in the following transcript(s): HUMCEA_PEA_1_T8 (SEQ ID NO: 502), HUMCEA_PEA_1_T25 (SEQ ID NO: 505) and HUMCEA_PEA_1_T26 (SEQ ID NO: 506). Table 59 below describes the starting and ending position of this segment on each transcript.

TABLE 59

Segment location on transcripts

| Transcript name | Segment starting position | Segment ending position |
|---|---|---|
| HUMCEA_PEA_1_T8 (SEQ ID NO: 502) | 2686 | 2786 |
| HUMCEA_PEA_1_T25 (SEQ ID NO: 505) | 1218 | 1318 |
| HUMCEA_PEA_1_T26 (SEQ ID NO: 506) | 1218 | 1318 |

Segment cluster HUMCEA_PEA_1_node_58 (SEQ ID NO: 544) according to the present invention is supported by 63 libraries. The number of libraries was determined as previously described. This segment can be found in the following transcript(s): HUMCEA_PEA_1_T8 (SEQ ID NO: 502), HUMCEA_PEA_1_T25 (SEQ ID NO: 505) and HUMCEA_PEA_1_T26 (SEQ ID NO: 506). Table 60 below describes the starting and ending position of this segment on each transcript.

TABLE 60

Segment location on transcripts

| Transcript name | Segment starting position | Segment ending position |
|---|---|---|
| HUMCEA_PEA_1_T8 (SEQ ID NO: 502) | 2787 | 2820 |
| HUMCEA_PEA_1_T25 (SEQ ID NO: 505) | 1319 | 1352 |
| HUMCEA_PEA_1_T26 (SEQ ID NO: 506) | 1319 | 1352 |

Segment cluster HUMCEA_PEA_1_node_60 (SEQ ID NO: 545) according to the present invention is supported by 55 libraries. The number of libraries was determined as previously described. This segment can be found in the following transcript(s): HUMCEA_PEA_1_T8 (SEQ ID NO: 502), HUMCEA_PEA_1_T25 (SEQ ID NO: 505) and HUMCEA_PEA_1_T26 (SEQ ID NO: 506). Table 61 below describes the starting and ending position of this segment on each transcript.

TABLE 61

Segment location on transcripts

| Transcript name | Segment starting position | Segment ending position |
|---|---|---|
| HUMCEA_PEA_1_T8 (SEQ ID NO: 502) | 2821 | 2864 |
| HUMCEA_PEA_1_T25 (SEQ ID NO: 505) | 1353 | 1396 |
| HUMCEA_PEA_1_T26 (SEQ ID NO: 506) | 1353 | 1396 |

Segment cluster HUMCEA_PEA_1_node_61 (SEQ ID NO: 546) according to the present invention can be found in the following transcript(s): HUMCEA_PEA_1_T8 (SEQ ID NO: 502), HUMCEA_PEA_1_T25 (SEQ ID NO: 505) and HUMCEA_PEA_1_T26 (SEQ ID NO: 506). Table 62 below describes the starting and ending position of this segment on each transcript.

TABLE 62

Segment location on transcripts

| Transcript name | Segment starting position | Segment ending position |
|---|---|---|
| HUMCEA_PEA_1_T8 (SEQ ID NO: 502) | 2865 | 2868 |
| HUMCEA_PEA_1_T25 (SEQ ID NO: 505) | 1397 | 1400 |
| HUMCEA_PEA_1_T26 (SEQ ID NO: 506) | 1397 | 1400 |

Segment cluster HUMCEA_PEA_1_node_62 (SEQ ID NO: 547) according to the present invention is supported by 60 libraries. The number of libraries was determined as previously described. This segment can be found in the following transcript(s): HUMCEA_PEA_1_T8 (SEQ ID NO: 502), HUMCEA_PEA_1_T25 (SEQ ID NO: 505) and HUMCEA_PEA_1_T26 (SEQ ID NO: 506). Table 63 below describes the starting and ending position of this segment on each transcript.

TABLE 63

Segment location on transcripts

| Transcript name | Segment starting position | Segment ending position |
|---|---|---|
| HUMCEA_PEA_1_T8 (SEQ ID NO: 502) | 2869 | 2956 |
| HUMCEA_PEA_1_T25 (SEQ ID NO: 505) | 1401 | 1488 |
| HUMCEA_PEA_1_T26 (SEQ ID NO: 506) | 1401 | 1488 |

Segment cluster HUMCEA_PEA_1_node_64 (SEQ ID NO: 548) according to the present invention is supported by 45 libraries. The number of libraries was determined as previously described. This segment can be found in the following transcript(s): HUMCEA_PEA_1_T8 (SEQ ID NO: 502), HUMCEA_PEA_1_T25 (SEQ ID NO: 505) and HUMCEA_PEA_1_T26 (SEQ ID NO: 506). Table 64 below describes the starting and ending position of this segment on each transcript.

TABLE 64

Segment location on transcripts

| Transcript name | Segment starting position | Segment ending position |
|---|---|---|
| HUMCEA_PEA_1_T8 (SEQ ID NO: 502) | 3136 | 3165 |
| HUMCEA_PEA_1_T25 (SEQ ID NO: 505) | 1668 | 1697 |
| HUMCEA_PEA_1_T26 (SEQ ID NO: 506) | 1668 | 1697 |

Variant protein alignment to the previously known protein:

Sequence name: CEA5_HUMAN

Sequence documentation:

Alignment of: HUMCEA_PEA_1_P4 (SEQ ID NO: 550) x CEA5_HUMAN . . .

Alignment segment 1/1:
    Quality: 2320.00

Escore: 0
  Matching length: 234 Total
length: 234
Matching Percent Similarity: 100.00 Matching Percent Identity: 100.00
  Total Percent Similarity: 100.00 Total Percent Identity: 100.00
  Gaps: 0
Alignment:

```
  1 MESPSAPPHRWCIPWQRLLLTASLLTFWNPPTTAKLTIESTPFNVAEGKE  50
    ||||||||||||||||||||||||||||||||||||||||||||||||||
  1 MESPSAPPHRWCIPWQRLLLTASLLTFWNPPTTAKLTIESTPFNVAEGKE  50

51 VLLLVHNLPQHLFGYSWYKGERVDGNRQIIGYVIGTQQATPGPAYSGREI 100
    |||||||||||||||||||| |||||||||||||||||||||||||||||
 51 VLLLVHNLPQHLFGYSWYKFERVDGNRQIIGYVIGTQQATPGPAYSGREI 100

101 IYPNASLLIQNIIQNDTGFYTLHVIKSDLVNEEATGQFRVYPELPKPSIS 150
    ||||||||||||||||||||||||||||||||||||||||| ||||||||
101 IYPNASLLIQNIIQNDTGFYTLHVIKSDLVNEEATGQFRVYPEKPKPSIS 150

151 SNNSKPVEDKDAVAFTCEPETQDATYLWWVNNQSLPVSPRLQLSNGNRTL 200
    ||||||||||||||||||||||||||||||||||||||||||||||||||
151 SNNSKPVEDKDAVAFTCEPETQDATYLWWVNNQSLPVSPRLQLSNGNRTL 200

201 TLFNVTRNDTASYKCETQNPVSARRSDSVILNVL                234
    |||||||||||||||||||||||||||||||||
201 TLFNVTRNDTASYKCETQNPVSARRSDSVILNVL                234
```

Sequence name: CEA5_HUMAN

Sequence documentation:

Alignment of: HUMCEA_PEA_1_P5 (SEQ ID NO: 551) x CEA5_HUMAN . . .

Alignment segment 1/1:
  Quality: 6692.00

Escore: 0
  Matching length: 675 Total
length: 675
Matching Percent Similarity: 100.00 Matching Percent Identity: 100.00
  Total Percent Similarity: 100.00 Total Percent Identity: 100.00
  Gaps: 0
Alignment:

```
  1 MESPSAPPHRWCIPWQRLLLTASLLTFWNPPTTAKLTIESTPFNVAEGKE  50
    ||||||||||||||||||||||||||||||||||||||||||||||||||
  1 MESPSAPPHRWCIPWQRLLLTASLLTFWNPPTTAKLTIESTPFNVAEGKE  50

51 VLLLVHNLPQHLFGYSWYKGERVDGNRQIIGYVIGTQQATPGPAYSGREI 100
    ||||||||||||||||||||||||||||||||||||||||||||||||||
 51 VLLLVHNLPQHLFGYSWYKGERVDGNRQIIGYVIGTQQATPGPAYSGREI 100

101 IYPNASLLIQNIIQNDTGFYTLHVIKSDLVNEEATGQFRVYPELPKPSIS 150
    ||||||||||||||||||||||||||||||||||||||||||||||||||
101 IYPNASLLIQNIIQNDTGFYTLHVIKSDLVNEEATGQFRVYPELPKPSIS 150

151 SNNSKPVEDKDAVAFTCEPETQDATYLWWVNNQSLPVSPRLQLSNGNRTL 200
    ||||||||||||||||||||||||||||||||||||||||||||||||||
151 SNNSKPVEDKDAVAFTCEPETQDATYLWWVNNQSLPVSPRLQLSNGNRTL 200

201 TLFNVTRNDTASYKCETQNPVSARRSDSVILNVLYGPDAPTISPLNTSYR 250
    ||||||||||||||||||||||||||||||||||||||||||||||||||
201 TLFNVTRNDTASYKCETQNPVSARRSDSVILNVLYGPDAPTISPLNTSYR 250

251 SGENLNLSCHAASNPPAQYSWFVNGTFQQSTQELFIPNITVNNSGSYTCQ 300
    ||||||||||||||||||||||||||||||||||||||||||||||||||
251 SGENLNLSCHAASNPPAQYSWFVNGTFQQSTQELFIPNITVNNSGSYTCQ 300

301 AHNSDTGLNRTTVTTITVYAEPPKPFITSNNSNPVEDEDAVALTCEPEIQ 350
    ||||||||||||||||||||||||||||||||||||||||||||||||||
301 AHNSDTGLNRTTVTTITVYAEPPKPFITSNNSNPVEDEDAVALTCEPEIQ 350

351 NTTYLWWVNNQSLPVSPRLQLSNDNRTLTLLSVTRNDVGPYECGIQNELS 400
    ||||||||||||||||||||||||||||||||||||||||||||||||||
351 NTTYLWWVNNQSLPVSPRLQLSNDNRTLTLLSVTRNDVGPYECGIQNELS 400
```

-continued

```
401 VDHSDPVILNVLYGPDDPTISPSYTYYRPGVNLSLSCHAASNPPAQYSWL 450
    ||||||||||||||||||||||||||||||||||||||||||||||||||
401 VDHSDPVILNVLYGPDDPTISPSYTYYRPGVNLSLSCHAASNPPAQYSWL 450

451 IDGNIQQHTQELFISNITEKNSGLYTCQANNSASGHSRTTVKTITVSAEL 500
    ||||||||||||||||||||||||||||||||||||||||||||||||||
451 IDGNIQQHTQELFISNITEKNSGLYTCQANNSASGHSRTTVKTITVSAEL 500

501 PKPSISSNNSKPVEDKDAVAFTCEPEAQNTTYLWWVNGQSLPVSPRLQLS 550
    ||||| ||||||||||||||||||||||||||||||||||||||||||||
501 PKPSOSSNNSKPVEDKDAVAFTCEPEAQNTTYLWWVNGQSLPVSPRLQLS 550

551 NGNRTLTLFNVTRNFARAYVCGIQNSVSANRSDPVTLDVLYGPDTPIISP 600
    ||||||||||||||| ||||||||||||||||||||||||||||||||||
551 NGNRTLTLFNVTRNDARAYVCGIQNSVSANRSDPVTLDVLYGPDTPIISP 600

601 PDSSYLSGANLNLSCHSASNPSPQYSWRINGIPQQHTQVLFIAKITPNNN 650
    ||||||||||||||||||||||||||||||||||||||||||||||||||
601 PDSSYLSGANLNLSCHSASNPSPQYSWRINGIPQQHTQVLFIAKITPNNN 650

651 GTYACFVSNLATGRNNSIVKSITVS                          675
    |||||||||||||||||||||||||
651 GTYACFVSNLATGRNNSIVKSITVS                          675
```

Sequence name: CEA5_HUMAN

Sequence documentation:

Alignment of: HUMCEA_PEA_1_P19 (SEQ ID NO: 553) x CEA5_HUMAN . . .

Alignment segment 1/1:
   Quality: 3298.00

Escore: 0

Matching length: 346 Total length: 702

Matching Percent Similarity: 100.00 Matching Percent Identity: 100.00

Total Percent Similarity: 49.29 Total Percent Identity: 49.29

Gaps: 1

Alignment:

```
  1 MESPSAPPHRWCIPWQRLLLTASLLTFWNPPTTAKLTIESTPFNVAEGKE  50
    ||||||||||||||||||||||||||||||||||||||||||||||||||
  1 MESPSAPPHRWCIPWQRLLLTASLLTFWNPPTTAKLTIESTPFNVAEGKE  50

51 VLLLVHNLPQHLFGYSWYKGERVDFNRQIIGYVIGTQQATPGPAYSGREI 100
    |||||||||||||||||||||| |||||||||||||||||||||||||||
 51 VLLLVHNLPQHLFGYSWYKGERVDGNRQIIGYVIGTQQATPGPAYSGREI 100

101 IYPNASLLIQNIIQNDTGFYTLHVIKSDLVNEEATGQFRVYPELPKPSIS 150
    ||||||||||||||||||||||||||||||||||||||||||||||||||
101 IYPNASLLIQNIIQNDTGFYTLHVIKSDLVNEEATGQFRVYPELPKPSIS 150

151 SNNSKPVEDKDAVAFTCEPETQDATYLWWVNNQSLPVSPRLQLSNGNRTL 200
    ||||||||||||||||||||||||||||||||||||||||||||||||||
151 SNNSKPVEDKDAVAFTCEPETQDATYLWWVNNQSLPVSPRLQLSNGNRTL 200

201 TLFNVTRNDTASYKCETQNPVSARRSDSVILN.................. 232
    |||||||||||||||||||||||||||||||
201 TLFNVTRNDTASYKCETQNPVSARRSDSVILNVLYGPDAPTISPLNTSYR 250

232 .................................................. 232
251 SGENLNLSCHAASNPPAQYSWFVNGTFQQSTQELFIPNITVNNSGSYTCQ 300

232 .................................................. 232
301 AHNSDTGLNRTTVTTITVYAEPPKPFITSNNSNPVEDEDAVALTCEPEIQ 350

232 .................................................. 232
351 NTTYLWWVNNQSLPVSPRLQLSNDNRTLTLLSVTRNDVGPYECGIQNELS 400

232 .................................................. 232
401 VDHSDPVILNVLYGPDDPTISPSYTYYRPGVNLSLSCHAASNPPAQYSWL 450
```

-continued

```
232  ..............................................  232
451  IDGNIQQHTQELFISNITEKNSGLYTCQANNSASGHSRTTVKTITVSAEL  500

232  ..............................................  232
501  PKPSISSNNSKPVEDKDAVAFTCEPEAQNTTYLWWVNGQSLPVSPRLQLS  550

233  ...............................VLYGPDTPIISP  244
                                    ||||||||||||
551  NGNRTLTLFNVTRNDARATVCGIQNSVSANRSDPVTLDVLYGPDTPIISP  600

245  PDSSYLSGANLNLSCHSASNPSPQYSWRINGIPQQHTQVLFIAKITPNNN  294
     |||||||||||||||||||||||||||||||||||||||||||||||||
601  PDSSYLSGANLNLSCHSASNPSPQYSWRINGIPQQHTQVLFIAKITPNNN  650

295  GTYACFVSNLATGRNNSIVKSITVSASGTSPGLSAGATVGIMIGVLVGVA  344
     |||||||||||||||||||||||||||||||||||||||||||||||||
651  GTYACFVSNLATGRNNSIVKSITVSASGTSPGLSAGATVGIMIGVLVGVA  700
345  LI  346
     ||
701  LI  702
```

Sequence name: CEA5_HUMAN                    length: 702

Sequence documentation:                       Matching Percent Similarity: 100.00 Matching Percent Alignment of: HUMCEA_PEA__1_P20 (SEQ ID NO: 554) x    Identity: 100.00
CEA5_HUMAN . . .                                Total Percent Similarity: 49.29 Total Percent Alignment segment 1/1:                          Identity: 49.29
    Quality: 3294.00                            Gaps: 1

Escore: 0                                      Alignment:
    Matching length: 346 Total

```
  1  MESPSAPPHRWCIPWQRLLLTASLLTFWNPPTTAKLTIESTPFNVAEGKE   50
     ||||||||||||||||||||||||||||||||||||||||||||||||||
  1  MESPSAPPHRWCIPWQRLLLTASLLTFWNPPTTAKLTIESTPFNVAEGKE   50

51  VLLLVHNLPQHLFGYSWYKGERVDGNRQIIGYVIGTQQATPGPAYSGREI  100
     |||||||||||||||||||||||||||||||||||||||||||||||||
 51  VLLLVHNLPQHLFGYSWYKGERVDGNRQIIGYVIGTQQATPGPAYSGREI  100

101  IYPNASLLIQNIIQNDTGFYTLHVIKSDLVNEEATGQFRVYP........  142
     |||||||||||||||||||||||||||||||||||||||||
101  IYPNASLLIQNIIQNDTGFYTLHVIKSDLVNEEATGQFRVYPELPKPSIS  150

142  ..............................................  142
151  SNNSKPVEDKDAVAFTCEPETQDATYLWWVNNQSLPVSPRLQLSNGNRTL  200

142  ..............................................  142
201  TLFNVTRNDTASYKCETQNPVSARRSDSVILNVLYGPDAPTISPLNTSYR  250

142  ..............................................  142
251  SGENLNLSCHAASNPPAQYSWFVNGTFQQSTQELFIPNITVNNSGSYTCQ  300

142  ..............................................  142
301  AHNSDTGLNRTTVTTITVYAEPPKPFITSNNSNPVEDEDAVALTCEPEIQ  350

142  ..............................................  142
351  NTTYLWWVNNQSLPVSPRLQLSNDNRTLTLLSVTRNDVGPYECGIQNELS  400

142  ..............................................  142
401  VDHSDPVILNVLYGPDDPTISPSYTYYRPGVNLSLSCHAASNPPAQYSWL  450
```

```
143 ................................................EL 144
                                                    | |
451 IDGNIQQHTQELFISNITEKNSGLYTCQANNSASGHSRTTVKTITVSAEL 500

145 PKPSISSNNSKPVEDKDAVAFTCEPEAQNTTYLWWVNGQSLPVSPRLQLS 194
    |||||||||||||||||||||||||||||||||||||||||||||||||
501 IDGNIQQHTQELFISNITEKNSGLYTCQANNSASGHSRTTVKTITVSAEL 550

195 NGNRTLTLFNVTRNDARAYVCGIQNSVSANRSDPVTLDVLYFPDTPIISP 244
    |||||||||||||||||||||||||||||||||||||||||||||||||
551 NGNRTLTLFNVTRNDARAYVCGIQNSVSANRSDPVTLDVLYFPDTPIISP 600

245 PDSSYLSGANLNLSCHSASNPSPQYSWRINGIPQQHTQVLFIAKITPNNN 294
    |||||||||||||||||||||||||||||||||||||||||||||||||
601 PDSSYLSGANLNLSCHSASNPSPQYSWRINGIPQQHTQVLFIAKITPNNN 650

295 GTYACFVSNLATGRNNSIVKSITVSASGTSPGLSAGATVGIMIGBLVGVA 344
    |||||||||||||||||||||||||||||||||||||||||||||||||
651 GTYACFVSNLATGRNNSIVKSITVSASGTSPGLSAGATVGIMIGBLVGVA 700

345 LI                                                346
    ||
701 LI                                                702
```

DESCRIPTION FOR CLUSTER HUMEDF

Cluster HUMEDF features 3 transcript(s) and 8 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| HUMEDF_PEA_2_T5 | 555 |
| HUMEDF_PEA_2_T10 | 556 |
| HUMEDF_PEA_2_T11 | 557 |

TABLE 2

Segments of interest

| Segment Name | SEQ ID NO: |
|---|---|
| HUMEDF_PEA_2_node_6 | 558 |
| HUMEDF_PEA_2_node_11 | 559 |
| HUMEDF_PEA_2_node_18 | 560 |
| HUMEDF_PEA_2_node_19 | 561 |
| HUMEDF_PEA_2_node_22 | 562 |
| HUMEDF_PEA_2_node_2 | 563 |
| HUMEDF_PEA_2_node_8 | 564 |
| HUMEDF_PEA_2_node_20 | 565 |

TABLE 3

Proteins of interest

| Protein Name | SEQ ID NO: | Corresponding Transcript(s) |
|---|---|---|
| HUMEDF_PEA_2_P5 | 567 | HUMEDF_PEA_2_T10 (SEQ ID NO: 556) |
| HUMEDF_PEA_2_P6 | 568 | HUMEDF_PEA_2_T11 (SEQ ID NO: 557) |
| HUMEDF_PEA_2_P8 | 569 | HUMEDF_PEA_2_T5 (SEQ ID NO: 555) |

These sequences are variants of the known protein Inhibin beta A chain precursor (SwissProt accession identifier IHBA_HUMAN; known also according to the synonyms Activin beta-A chain; Erythroid differentiation protein; EDF), SEQ ID NO: 566, referred to herein as the previously known protein.

Protein Inhibin beta A chain precursor is known or believed to have the following function(s): inhibins and activins inhibit and activate, respectively, the secretion of follitropin by the pituitary gland. Inhibins/activins are involved in regulating a number of diverse functions such as hypothalamic and pituitary hormone secretion, gonadal hormone secretion, germ cell development and maturation, erythroid differentiation, insulin secretion, nerve cell survival, embryonic axial development or bone growth, depending on their subunit composition. Inhibins appear to oppose the functions of activins. The sequence for protein Inhibin beta A chain precursor is given at the end of the application, as "Inhibin beta A chain precursor amino acid sequence". Known polymorphisms for this sequence are as shown in Table 4.

TABLE 4

Amino acid mutations for Known Protein

| SNP position(s) on amino acid sequence | Comment |
|---|---|
| 377-379 | RMR -> AC |

The previously known protein also has the following indication(s) and/or potential therapeutic use(s): Cancer; Osteoporosis; Contraceptive, female; Contraceptive, male; Diagnosis, cancer. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Erythroid differentiation factor agonist; Follicle-stimulating hormone agonist; Growth factor agonist; Inhibin agonist; Interleukin 6 antagonist; Osteoblast stimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Haematological; Female contraceptive; Male contraceptive; Antianaemic; Osteoporosis treatment; Fertility enhancer; Anticancer; Diagnostic; Antisickling; Neurological; Alimentary/Metabolic.

The following GO Annotation(s) apply to the previously known protein. The following annotation(s) were found: skeletal development; ovarian follicle development; induction of apoptosis; defense response; cell cycle arrest; cell surface receptor linked signal transduction; cell-cell signaling; neurogenesis; mesoderm development; cell growth and/or maintenance; response to external stimulus; cell differentiation; erythrocyte differentiation; growth, which are annotation(s) related to Biological Process; defense/immunity protein; cytokine; transforming growth factor beta receptor ligand; hormone; protein binding; growth factor; activin inhibitor, which are annotation(s) related to Molecular Function; and extracellular, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

As noted above, cluster HUMEDF features 3 transcript(s), which were listed in Table 1 above. These transcript(s) encode for protein(s) which are variant(s) of protein Inhibin beta A chain precursor. A description of each variant protein according to the present invention is now provided.

Variant protein HUMEDF_PEA_2_P5 (SEQ ID NO: 567) according to the present invention has an amino acid sequence as given at the end of the application; it is encoded by transcript(s) HUMEDF_PEA_2_T10 (SEQ ID NO: 556). An alignment is given to the known protein (Inhibin beta A chain precursor) at the end of the application. One or more alignments to one or more previously published protein sequences are given at the end of the application. A brief description of the relationship of the variant protein according to the present invention to each such aligned protein is as follows:

Comparison report between HUMEDF_PEA_2_P5 (SEQ ID NO: 567) and IHBA_HUMAN:

1. An isolated chimeric polypeptide encoding for HUMEDF_PEA_2_P5 (SEQ ID NO: 567), comprising a first amino acid sequence being at least 90% homologous to MPLLWLRGFLLASCWIIVRSSPTPG-SEGHSAAPDCPSCALAALPKDVPNSQPEMVEAVK KHILNMLHLKKRPDVTQPVP-KAALLNAIRKLHVGKVGENGYVEIEDDI-GRRAEMNELM EQTSEIITFAESGT corresponding to amino acids 1-131 of IHBA_HUMAN, which also corresponds to amino acids 1-131 of HUMEDF_PEA_2_P5 (SEQ ID NO: 567), and a second amino acid sequence being at least 70%, optionally at least 80%, preferably at least 85%, more preferably at least 90% and most preferably at least 95% homologous to a polypeptide having the sequence VKS (SEQ ID NO: 1147) corresponding to amino acids 132-134 of HUMEDF_PEA_2_P5 (SEQ ID NO: 567), wherein said first amino acid sequence and second amino acid sequence are contiguous and in a sequential order.

2. An isolated polypeptide encoding for a tail of HUMEDF_PEA_2_P5 (SEQ ID NO: 567), comprising a polypeptide being at least 70%, optionally at least about 80%, preferably at least about 85%, more preferably at least about 90% and most preferably at least about 95% homologous to the sequence VKS (SEQ ID NO: 1147) in HUMEDF_PEA_2_P5 (SEQ ID NO: 567).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

The glycosylation sites of variant protein HUMEDF_PEA_2_P5 (SEQ ID NO: 567), as compared to the known protein Inhibin beta A chain precursor, are described in Table 5 (given according to their position(s) on the amino acid sequence in the first column; the second column indicates whether the glycosylation site is present in the variant protein; and the last column indicates whether the position is different on the variant protein).

TABLE 5

| Glycosylation site(s) | |
|---|---|
| Position(s) on known amino acid sequence | Present in variant protein ? |
| 165 | no |

Variant protein HUMEDF_PEA_2_P5 (SEQ ID NO: 567) is encoded by the following transcript(s): HUMEDF_PEA_2_T10 (SEQ ID NO: 556), for which the sequence(s) is/are given at the end of the application. The coding portion of transcript HUMEDF_PEA_2_T10 (SEQ ID NO: 556) is shown in bold; this coding portion starts at position 246 and ends at position 647. The transcript also has the following SNPs as listed in Table 6 (given according to their position on the nucleotide sequence, with the alternative nucleic acid listed; the last column indicates whether the SNP is known or not; the presence of known SNPs in variant protein HUMEDF_PEA_2_P5 (SEQ ID NO: 567) sequence provides support for the deduced sequence of this variant protein according to the present invention).

TABLE 6

| Nucleic acid SNPs | | |
|---|---|---|
| SNP position on nucleotide sequence | Alternative nucleic acid | Previously known SNP? |
| 139 | -> A | No |
| 170 | A -> | No |
| 347 | C -> T | No |
| 362 | G -> C | No |

Variant protein HUMEDF_PEA_2_P6 (SEQ ID NO: 568) according to the present invention has an amino acid sequence as given at the end of the application; it is encoded by transcript(s) HUMEDF_PEA_2_T11 (SEQ ID NO: 557). An alignment is given to the known protein (Inhibin beta A chain precursor) at the end of the application. One or more alignments to one or more previously published protein sequences are given at the end of the application. A brief description of the relationship of the variant protein according to the present invention to each such aligned protein is as follows:

Comparison report between HUMEDF_PEA_2_P6 (SEQ ID NO: 568) and IHBA_HUMAN:

1. An isolated chimeric polypeptide encoding for HUMEDF_PEA_2_P6 (SEQ ID NO: 568), comprising a first amino acid sequence being at least 90% homologous to MPLLWLRGFLLASCWIIVRSSPTPG-SEGHSAAPDCPSCALAALPKDVPNSQPEMVEAVK KHILNMLHLKKRPDVTQPVP-KAALLNAIRKLHVGKVGENGYVEIEDDI-GRRAEMNELM EQTSEIITFAESG corresponding to amino acids 1-130 of IHBA_HUMAN, which also corresponds to amino acids 1-130 of HUMEDF_PEA_2_P6 (SEQ ID NO: 568), and a second amino acid sequence being at least 70%, optionally at least 80%, preferably at least 85%, more preferably at least 90% and most preferably at least 95% homologous to a polypeptide having the sequence HSEA (SEQ ID NO: 1148) corresponding to amino acids 131-134 of HUMEDF_PEA_2_P6 (SEQ ID NO: 568), wherein said first amino acid sequence and second amino acid sequence are contiguous and in a sequential order.

2. An isolated polypeptide encoding for a tail of HUMEDF_PEA_2_P6 (SEQ ID NO: 568), comprising a polypeptide being at least 70%, optionally at least about 80%, preferably at least about 85%, more preferably at least about 90% and most preferably at least about 95% homologous to the sequence HSEA (SEQ ID NO: 1148) in HUMEDF_PEA_2_P6 (SEQ ID NO: 568).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

The glycosylation sites of variant protein HUMEDF_PEA_2_P6 (SEQ ID NO: 568), as compared to the known protein Inhibin beta A chain precursor, are described in Table 7 (given according to their position(s) on the amino acid sequence in the first column; the second column indicates whether the glycosylation site is present in the variant protein; and the last column indicates whether the position is different on the variant protein).

TABLE 7

Glycosylation site(s)

| Position(s) on known amino acid sequence | Present in variant protein ? |
|---|---|
| 165 | no |

Variant protein HUMEDF_PEA_2_P6 (SEQ ID NO: 568) is encoded by the following transcript(s): HUMEDF_PEA_2_T11 (SEQ ID NO: 557), for which the sequence(s) is/are given at the end of the application. The coding portion of transcript HUMEDF_PEA_2_T11 (SEQ ID NO: 557) is shown in bold; this coding portion starts at position 246 and ends at position 647. The transcript also has the following SNPs as listed in Table 8 (given according to their position on the nucleotide sequence, with the alternative nucleic acid listed; the last column indicates whether the SNP is known or not; the presence of known SNPs in variant protein HUMEDF_PEA_2_P6 (SEQ ID NO: 568) sequence provides support for the deduced sequence of this variant protein according to the present invention).

TABLE 8

Nucleic acid SNPs

| SNP position on nucleotide sequence | Alternative nucleic acid | Previously known SNP? |
|---|---|---|
| 139 | -> A | No |
| 170 | A -> | No |
| 347 | C -> T | No |
| 362 | G -> C | No |

Variant protein HUMEDF_PEA_2_P8 (SEQ ID NO: 569) according to the present invention has an amino acid sequence as given at the end of the application; it is encoded by transcript(s) HUMEDF_PEA_2_T5 (SEQ ID NO: 555). An alignment is given to the known protein (Inhibin beta A chain precursor) at the end of the application. One or more alignments to one or more previously published protein sequences are given at the end of the application. A brief description of the relationship of the variant protein according to the present invention to each such aligned protein is as follows:

Comparison report between HUMEDF_PEA_2_P8 (SEQ ID NO: 569) and IHBA_HUMAN:

1. An isolated chimeric polypeptide encoding for HUMEDF_PEA_2_P8 (SEQ ID NO: 569), comprising a first amino acid sequence being at least 90% homologous to MPLLWLRGFLLASCWIIVRSSPTPG-SEGHSAAPDCPSCALAALPKDVPNSQPEMVEAVK KHILNMLHLKKRPDVTQPVP-KAALLNAIRKLHVGKVGENGYVEIEDDI-GRRAEMNELM EQTSEIITFAESGT corresponding to amino acids 1-131 of IHBA_HUMAN, which also corresponds to amino acids 1-131 of HUMEDF_PEA_2_P8 (SEQ ID NO: 569), and a second amino acid sequence being at least 70%, optionally at least 80%, preferably at least 85%, more preferably at least 90% and most preferably at least 95% homologous to a polypeptide having the sequence VKS (SEQ ID NO: 1147) corresponding to amino acids 132-134 of HUMEDF_PEA_2_P8 (SEQ ID NO: 569), wherein said first amino acid sequence and second amino acid sequence are contiguous and in a sequential order.

2. An isolated polypeptide encoding for a tail of HUMEDF_PEA_2_P8 (SEQ ID NO: 569), comprising a polypeptide being at least 70%, optionally at least about 80%, preferably at least about 85%, more preferably at least about 90% and most preferably at least about 95% homologous to the sequence VKS (SEQ ID NO: 1147) in HUMEDF_PEA_2_P8 (SEQ ID NO: 569).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

The glycosylation sites of variant protein HUMEDF_PEA_2_P8 (SEQ ID NO: 569), as compared to the known protein Inhibin beta A chain precursor, are described in Table 9 (given according to their position(s) on the amino acid sequence in the first column; the second column indicates whether the glycosylation site is present in the variant protein; and the last column indicates whether the position is different on the variant protein).

TABLE 9

Glycosylation site(s)

| Position(s) on known amino acid sequence | Present in variant protein ? |
|---|---|
| 165 | no |

Variant protein HUMEDF_PEA_2_P8 (SEQ ID NO: 569) is encoded by the following transcript(s): HUMEDF_PEA_2_T5 (SEQ ID NO: 555), for which the sequence(s) is/are given at the end of the application. The coding portion of transcript HUMEDF_PEA_2_T5 (SEQ ID NO: 555) is shown in bold; this coding portion starts at position 246 and ends at position 647. The transcript also has the following SNPs as listed in Table 10 (given according to their position on the nucleotide sequence, with the alternative nucleic acid listed; the last column indicates whether the SNP is known or not; the presence of known SNPs in variant protein HUMEDF_PEA_2_P8 (SEQ ID NO: 569) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 139 | -> A | No |
| 170 | A -> | No |
| 347 | C -> T | No |
| 362 | G -> C | No |
| 878 | G -> | No |
| 1028 | G -> | No |
| 1216 | A -> G | No |
| 1552 | A -> | No |
| 1627 | G -> T | No |
| 1735 | A -> | No |

As noted above, cluster HUMEDF features 8 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMEDF_PEA_2_node_6 (SEQ ID NO: 558) according to the present invention is supported by 65 libraries. The number of libraries was determined as previously described. This segment can be found in the following transcript(s): HUMEDF_PEA_2_T5 (SEQ ID NO: 555), HUMEDF_PEA_2_T10 (SEQ ID NO: 556) and HUMEDF_PEA_2_T11 (SEQ ID NO: 557). Table 11 below describes the starting and ending position of this segment on each transcript.

TABLE 11

Segment location on transcripts

| Transcript name | Segment starting position | Segment ending position |
|---|---|---|
| HUMEDF_PEA_2_T5 (SEQ ID NO: 555) | 103 | 633 |
| HUMEDF_PEA_2_T10 (SEQ ID NO: 556) | 103 | 633 |
| HUMEDF_PEA_2_T11 (SEQ ID NO: 557) | 103 | 633 |

Segment cluster HUMEDF_PEA_2_node_11 (SEQ ID NO: 559) according to the present invention is supported by 5 libraries. The number of libraries was determined as previously described. This segment can be found in the following transcript(s): HUMEDF_PEA_2_T10 (SEQ ID NO: 556) and HUMEDF_PEA_2_T11 (SEQ ID NO: 557). Table 12 below describes the starting and ending position of this segment on each transcript.

TABLE 12

Segment location on transcripts

| Transcript name | Segment starting position | Segment ending position |
|---|---|---|
| HUMEDF_PEA_2_T10 (SEQ ID NO: 556) | 718 | 1129 |
| HUMEDF_PEA_2_T11 (SEQ ID NO: 557) | 634 | 1045 |

Segment cluster HUMEDF_PEA_2_node_18 (SEQ ID NO: 560) according to the present invention is supported by 90 libraries. The number of libraries was determined as previously described. This segment can be found in the following transcript(s): HUMEDF_PEA_2_T5 (SEQ ID NO: 555). Table 13 below describes the starting and ending position of this segment on each transcript.

TABLE 13

Segment location on transcripts

| Transcript name | Segment starting position | Segment ending position |
|---|---|---|
| HUMEDF_PEA_2_T5 (SEQ ID NO: 555) | 718 | 1660 |

Segment cluster HUMEDF_PEA_2_node_19 (SEQ ID NO: 561) according to the present invention is supported by 86 libraries. The number of libraries was determined as previously described. This segment can be found in the following transcript(s): HUMEDF_PEA_2_T5 (SEQ ID NO: 555). Table 14 below describes the starting and ending position of this segment on each transcript.

TABLE 14

Segment location on transcripts

| Transcript name | Segment starting position | Segment ending position |
|---|---|---|
| HUMEDF_PEA_2_T5 (SEQ ID NO: 555) | 1661 | 4414 |

Segment cluster HUMEDF_PEA_2_node_22 (SEQ ID NO: 562) according to the present invention is supported by 89 libraries. The number of libraries was determined as previously described. This segment can be found in the following transcript(s): HUMEDF_PEA_2_T5 (SEQ ID NO: 555). Table 15 below describes the starting and ending position of this segment on each transcript.

TABLE 15

Segment location on transcripts

| Transcript name | Segment starting position | Segment ending position |
|---|---|---|
| HUMEDF_PEA_2_T5 (SEQ ID NO: 555) | 4474 | 6164 |

According to an optional embodiment of the present invention, short segments related to the above cluster are also provided. These segments are up to about 120 bp in length, and so are included in a separate description.

Segment cluster HUMEDF_PEA_2_node_2 (SEQ ID NO: 563) according to the present invention is supported by 31 libraries. The number of libraries was determined as previously described. This segment can be found in the following transcript(s): HUMEDF_PEA_2_T5 (SEQ ID NO: 555), HUMEDF_PEA_2_T10(SEQ ID NO: 556) and HUMEDF_PEA_2_T11 (SEQ ID NO: 557). Table 16 below describes the starting and ending position of this segment on each transcript.

TABLE 16

Segment location on transcripts

| Transcript name | Segment starting position | Segment ending position |
|---|---|---|
| HUMEDF_PEA_2_T5 (SEQ ID NO: 555) | 1 | 102 |
| HUMEDF_PEA_2_T10 (SEQ ID NO: 556) | 1 | 102 |
| HUMEDF_PEA_2_T11 (SEQ ID NO: 557) | 1 | 102 |

Segment cluster HUMEDF_PEA_2_node_8 (SEQ ID NO: 564) according to the present invention is supported by 5 libraries. The number of libraries was determined as previously described. This segment can be found in the following transcript(s): HUMEDF_PEA_2_T5 (SEQ ID NO: 555) and HUMEDF_PEA_2_T10 (SEQ ID NO: 556). Table 17 below describes the starting and ending position of this segment on each transcript.

TABLE 17

Segment location on transcripts

| Transcript name | Segment starting position | Segment ending position |
|---|---|---|
| HUMEDF_PEA_2_T5 (SEQ ID NO: 555) | 634 | 717 |
| HUMEDF_PEA_2_T10 (SEQ ID NO: 556) | 634 | 717 |

Segment cluster HUMEDF_PEA_2_node_20 (SEQ ID NO: 565) according to the present invention is supported by 18 libraries. The number of libraries was determined as previously described. This segment can be found in the following transcript(s): HUMEDF_PEA_2_T5 (SEQ ID NO: 555). Table 18 below describes the starting and ending position of this segment on each transcript.

TABLE 18

Segment location on transcripts

| Transcript name | Segment starting position | Segment ending position |
|---|---|---|
| HUMEDF_PEA_2_T5 (SEQ ID NO: 555) | 4415 | 4473 |

Variant protein alignment to the previously known protein:

Sequence name: IHBA_HUMAN

Sequence documentation:

Alignment of: HUMEDF_PEA_2_P5 (SEQ ID NO: 567) x IHBA_HUMAN . . .

Alignment segment 1/1:
   Quality: 1285.00

Escore: 0
   Matching length: 133 Total length: 133

Matching Percent Similarity: 99.25 Matching Percent

Identity: 98.50
   Total Percent Similarity: 99.25 Total Percent

Identity: 98.50
   Gaps: 0

Alignment:

```
  1 MPLLWLRGFLLASCWIIVRSSPTPGSEGHSAAPDCPSCALAALPKDVPNS  50
    |||||||||||||||||||||||||||||||||||||||||||||||||
  1 MPLLWLRGFLLASCWIIVRSSPTPGSEGHSAAPDCPSCALAALPKDVPNS  50

51 QPEMVEAVKKHILNMLHLKKRPDVTQPVPKAALLNAIRKLHVGKVGENGY 100
    |||||||||||||||||||||||||||||||||||||||||||||||||
 51 QPEMVEAVKKHILNMLHLKKRPDVTQPVPKAALLNAIRKLHVGKVGENGY 100

101 VEIEDDIGRRAEMNELMEQTSEIITFAESGTVK                 133
    |||||||||||||||||||||||||||||||  :
101 VEIEDDIGRRAEMNELMEQTSEIITFAESGTAR                 133
```

Sequence name: IHBA_HUMAN

Sequence documentation:

Alignment of: HUMEDF_PEA__2_P6 (SEQ ID NO: 568) x IHBA_HUMAN ...

Alignment segment 1/1:
  Quality: 1275.00

Escore: 0
  Matching length: 130 Total length: 130

Matching Percent Similarity: 100.00 Matching Percent

Identity: 100.00
  Total Percent Similarity: 100.00 Total Percent

Identity: 100.00
  Gaps: 0

```
  1 MPLLWLRGFLLASCWIIVRSSPTPGSEGHSAAPDCPSCALAALPKDVPNS  50
    ||||||||||||||||||||||||||||||||||||||||||||||||||
  1 MPLLWLRGFLLASCWIIVRSSPTPGSEGHSAAPDCPSCALAALPKDVPNS  50

51 QPEMVEAVKKHILNMLHLKKRPDVTQPVPKAALLNAIRKLHVGKVGENGY 100
    ||||||||||||||||||||||||||||||||||||||||||||||||||
 51 QPEMVEAVKKHILNMLHLKKRPDVTQPVPKAALLNAIRKLHVGKVGENGY 100

101 VEIEDDIGRRAEMNELMEQTSEIITFAESG                    130
    |||||||||||||||||||||||||||||
101 VEIEDDIGRRAEMNELMEQTSEIITFAESG                    130
```

Sequence name: IHBA_HUMAN

Sequence documentation:

Alignment of: HUMEDF_PEA__2_P8 (SEQ ID NO: 569) x IHBA_HUMAN ...

Alignment segment 1/1:
  Quality: 1285.00

Escore: 0
  Matching length: 133 Total length: 133

Matching Percent Similarity: 99.25 Matching Percent

Identity: 98.50
  Total Percent Similarity: 99.25 Total Percent

Identity: 98.50
  Gaps: 0

Alignment:

```
  1 MPLLWLRGFLLASCWIIVRSSPTPGSEGHSAAPDCPSCALAALPKDVPNS  50
    ||||||||||||||||||||||||||||||||||||||||||||||||||
  1 MPLLWLRGFLLASCWIIVRSSPTPGSEGHSAAPDCPSCALAALPKDVPNS  50

51 QPEMVEAVKKHILNMLHLKKRPDVTQPVPKAALLNAIRKLHVGKVGENGY 100
    ||||||||||||||||||||||||||||||||||||||||||||||||||
 51 QPEMVEAVKKHILNMLHLKKRPDVTQPVPKAALLNAIRKLHVGKVGENGY 100

101 VEIEDDIGRRAEMNELMEQTSEIITFAESGTVK                 133
    ||||||||||||||||||||||||||||||  :
101 VEIEDDIGRRAEMNELMEQTSEIITFAESGTAR                 133
```

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination. Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims. All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention.

SEQUENCE LISTING (1150 sequences)

SEQ ID NO: 1 - DNA, 1205 bp, Homo sapiens
ggaggcgctcggggcatccgaggcggggaggcgggtccgccccctattgtgtagcggcgagagtggagccgagcggtgcggagcagatctggtggttctccggagagcagcttccttgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggtgactgtgggttccctgccttccgagagcttaagagagcagagactgtgtctcctgttttcttcacacgccgctgcatatgggaagatctgaagtcaacaggctttagccctgcaggtggagggaggcctccaggaggtgggcccaggactcaggaggactcagggctgccctgctggcgatcttcctgttctgtaacactacaggtctagcagtccagctgtcacagaaaagctaggacatgcagtatgcttctttggatattctgagtaacatttggactgttacccattggctaccagcatctcccaagtgagaatacatagattacccccagtgccctgaacagcactcggtcctaacacccgtgtccatggaaagcacgccgcgtctggagaaagaagccgaaggctcttgtcacttactagccatgtgattttggaaagaaacttaacattaattccttcagctacaatggaattcttgggaggattaaatatggtgacaacgcctaatattagatggcctgtattccacactcaatcttccttccctcttcttccttctttgtagagctataatgaaaagtatcatgtgggacacagaagaggttgcagtctggggtctgcagggcttagcggccaggcagattagctttcttgaggaatcctgacagtgggtggaagggtatgatgatg

SEQ ID NO: 2 - DNA, 715 bp, Homo sapiens
ggaggcgctcggggcatccgaggcggggaggcgggtccgccccctattgtgtagcggcgagagtggagccgagcggtgcggagcagatctggtggttctccggagagcagcttccttgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggataagagttctcctcaggtgggaggtagggaggtatcagcaagaaaggtgggctgggtagagtcgcacaaggcctcctatgaacggctttgtccctgctctgatctcatctccagctctgctgccttaactctgcttaataagcatggctgtgctcccaagcagtgttaattcattgaaagatgtcattcatttacacacacacaca

SEQ ID NO: 3 - DNA, 232 bp, Artificial
  Synthetic oligonucleotide
atctggtggttctccggagagcagcttccttgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacg

SEQ ID NO: 4 - DNA, 189 bp, Artificial
  Synthetic oligonucleotide
gtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgg

SEQ ID NO: 5 - DNA, 201 bp, Artificial
  Synthetic oligonucleotide
gttctcctcaggtgggaggtagggaggtatcagcaagaaaggtgggctgggtagagtcgcacaaggcctcctatgaacggctttgtccctgctctgatctcatctccagctctgctgccttaactctgcttaataagcatggctgtgctcccaagcagtgttaattcattgaaagatgtcattcatttacacacacacaca

SEQ ID NO: 6 - DNA, 698 bp, Artificial
  Synthetic oligonucleotide
gtgactgtgggttccctgccttccgagagcttaagagagcagagactgtgtctcctgttttcttcacacgccgctgcatatgggaagatctgaagtcaacaggctttagccctgcaggtggagggaggcctccaggaggtgggcccaggactcaggaggactcagggctgccctgctggcgatcttcctgttctgtaacactacaggtctagcagtccagctgtcacagaaaagctaggacatgcagtatgcttctttggatattctgagtaacatttggactgttacccattggctaccagcatctcccaagtgagaatacatagattacccccagtgccctgaacagcactcggtcctaacacccgtgtccatggaaagcacgccgcgtctggagaaagaagccgaaggctcttgtcacttactagccatgtgattttggaaagaaacttaacattaattccttcagctacaatggaattcttgggaggattaaatatggtgacaacgcctaatattagatggcctgtattccacactcaatcttccttccctcttcttccttctttgtagagctataatgaaaagtatcatgtgggacacagaagaggttgcagtctggggtctgcagggcttagcggccaggcagattagctttcttgaggaatcctgacagtgggtggaagggtatgatgatg

SEQ ID NO: 7 - DNA, 86 bp, Artificial
  Synthetic oligonucleotide
ggaggcgctcggggcatccgaggcggggaggcgggtccgccccctattgtgtagcggcgagagtggagccgagcggtgcggagcag

SEQ ID NO: 8 - DNA, 7 bp, Artificial
  Synthetic oligonucleotide
gataaga

SEQ ID NO: 9 - protein, 152 aa, Homo sapiens
MVWCLGLAVLSLVISQGADGRGKPEVVSVVGRAGESVVLGCDLLPPAGRPPLHVIEWLRFGFLLPIFIQFGLYSPRIDPDYVGDCGFPAFRELKRAETVSPVFFTRRCIWEDLKSTGFSPAGGGRPPGGGPRTQEDSGLPCWRSSCSVTLQV

SEQ ID NO: 10 - protein, 83 aa, Homo sapiens
MVWCLGLAVLSLVISQGADGRGKPEVVSVVGRAGESVVLGCDLLPPAGRPPLHVIEWLRFGFLLPIFIQFGLYSPRIDPDYVG

SEQ ID NO: 11 - DNA, 1572 bp, Homo sapiens
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtaagtggagggggtggaggggaggatgcatggctcggagcctggtggccggagctgcgtgtggccagcacctggggacaaggccctagcctgacgcccacttaggggcctctgctcttgggcttcaggacctgggagaggcaaggaagggggttctggttcctggaattaggcctgaaatctgctggctgtgcagggggattagcctcattgggcacaagaagaaactgaagctcagagaggggagtggcccgcggcatgtggcacaagtgacagcggtacggcccaggcaagtttgagccctggctgggaactgggacttaacagctcctgggctatggagcctgggacctggagtcagctctactgtgtgcatggccagggcagaagccagccaagttatctctgcccatcctgacgattgccctcctccccaggcagtggggagcatgtggtga

SEQ ID NO: 12 - DNA, 2426 bp, Homo sapiens
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggaca

SEQ ID NO: 13 - DNA, 2471 bp, Homo sapiens
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggaca

SEQ ID NO: 14 - DNA, 2370 bp, Homo sapiens
tgtggattcaagaggcctgctctgccagacagccccctgaggatctgggggtgaagggagagaggggctgctcactgacatttacagagccatgcccagtgccaactgcccgagcctgccttggtaccgaactagagagcttctgggtacccaagcaggctgattggagaggcaggagcacgagagactgaggcccccactccccactgcagggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggaca

SEQ ID NO: 15 - DNA, 2525 bp, Homo sapiens
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggaca

SEQ ID NO: 16 - DNA, 2456 bp, Homo sapiens
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggaca

SEQ ID NO: 17 - DNA, 1601 bp, Homo sapiens
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggaca

SEQ ID NO: 18 - DNA, 165 bp, Artificial
  Synthetic oligonucleotide
gattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccag

SEQ ID NO: 19 - DNA, 120 bp, Artificial
  Synthetic oligonucleotide
agaaagagaaagaccccaagtactggcgagaccaagcgcaagagacactgaaatatgccctggagcttcagaagctcaacaccaacgtggctaagaatgtcatcatgttcctgggagatg

SEQ ID NO: 20 - DNA, 212 bp, Artificial
  Synthetic oligonucleotide
tgtggattcaagaggcctgctctgccagacagccccctgaggatctgggggtgaagggagagaggggctgctcactgacatttacagagccatgcccagtgccaactgcccgagcctgccttggtaccgaactagagagcttctgggtacccaagcaggctgattggagaggcaggagcacgagagactgaggcccccactccccactgcag

SEQ ID NO: 21 - DNA, 175 bp, Artificial
  Synthetic oligonucleotide
acgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctg

SEQ ID NO: 22 - DNA, 148 bp, Artificial
  Synthetic oligonucleotide
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcag

SEQ ID NO: 23 - DNA, 176 bp, Artificial
  Synthetic oligonucleotide
ggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgac

SEQ ID NO: 24 - DNA, 144 bp, Artificial
  Synthetic oligonucleotide
gtgatcatggggggtggccggaaatacatgtaccccaagaataaaactgatgtggagtatgagagtgacgagaaagccaggggcacgaggctggacggcctggacctcgttgacacctggaagagcttcaaaccgagatacaag

SEQ ID NO: 25 - DNA, 458 bp, Artificial
  Synthetic oligonucleotide
gtaagtggagggggtggaggggaggatgcatggctcggagcctggtggccggagctgcgtgtggccagcacctggggacaaggccctagcctgacgcccacttaggggcctctgctcttgggcttcaggacctgggagaggcaaggaagggggttctggttcctggaattaggcctgaaatctgctggctgtgcagggggattagcctcattgggcacaagaagaaactgaagctcagagaggggagtggcccgcggcatgtggcacaagtgacagcggtacggcccaggcaagtttgagccctggctgggaactgggacttaacagctcctgggctatggagcctgggacctggagtcagctctactgtgtgcatggccagggcagaagccagccaagttatctctgcccatcctgacgattgccctcctccccaggcagtggggagcatgtggtga

SEQ ID NO: 26 - DNA, 135 bp, Artificial
  Synthetic oligonucleotide
gtctcttcgagccaggggacatgcagtacgagctgaacaggaacaacgtgacggacccgtcactctccgagatggtggtggtggccatccagatcctgcggaagaaccccaaaggcttcttcttgctggtggaag

SEQ ID NO: 27 - DNA, 120 bp, Artificial
  Synthetic oligonucleotide
gtctggcccccatgctgagtgacacagacaagaagcccttcactgccatcctgtatggcaatgggcctggctacaaggtggtgggcggtgaacgagagaatgtctccatggtggactatg

SEQ ID NO: 28 - DNA, 363 bp, Artificial
  Synthetic oligonucleotide
ctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcag

SEQ ID NO: 29 - DNA, 557 bp, Artificial
  Synthetic oligonucleotide
ctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggaca

SEQ ID NO: 30 - DNA, 116 bp, Artificial
  Synthetic oligonucleotide
ggatgggtgtctccacagtgacggctgcccgcatcctcaagggtcagctccaccacaaccctggggaggagaccaggctggagatggacaagttccccttcgtggccctctccaag

SEQ ID NO: 31 - DNA, 70 bp, Artificial
  Synthetic oligonucleotide
cactcccacttcatctggaaccgcacggaactcctgacccttgacccccacaatgtggactacctattgg

SEQ ID NO: 32 - DNA, 71 bp, Artificial
  Synthetic oligonucleotide
gaggcagaattgaccacgggcaccatgaaggaaaagccaagcaggccctgcatgaggcggtggagatggac

SEQ ID NO: 33 - DNA, 66 bp, Artificial
  Synthetic oligonucleotide
cgggccatcgggcaggcaggcagcttgacctcctcggaagacactctgaccgtggtcactgcggac

SEQ ID NO: 34 - DNA, 55 bp, Artificial
  Synthetic oligonucleotide
cattcccacgtcttcacatttggtggatacaccccccgtggcaactctatctttg

SEQ ID NO: 35 - DNA, 110 bp, Artificial
  Synthetic oligonucleotide
cctctgcaactgcaagaaaggggacccaggaaaccaaagtctgccgcccacctcgctcccctctggaatcttccccaagggccaaacccacttctggcctccagcctttg

SEQ ID NO: 36 - protein, 524 aa, Homo sapiens [sequence omitted]

SEQ ID NO: 37 - protein, 553 aa, Homo sapiens
PHSGPAAAFIRRRGWWPGPRCAPATPRPLSWLRAPTRLCLDGPSPVLCAEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 38 - protein, 484 aa, Homo sapiens
MISPFLVLAIGTCLTNSLVPGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 39 - protein, 463 aa, Homo sapiens [sequence omitted]

SEQ ID NO: 40 - protein, 502 aa, Homo sapiens
MISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 41 - protein, 479 aa, Homo sapiens
MISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 42 - protein, 306 aa, Homo sapiens
MISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKLPPRCPLANRVDFSWAGREYRLQTFSKPLIFLANVFLQTQRP

SEQ ID NO: 43 - protein, 316 aa, Homo sapiens [sequence omitted]

SEQ ID NO: 44 - DNA, 2518 bp, Homo sapiens
tgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctatggcccagatgtccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctgattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataactaaa

SEQ ID NO: 45 - DNA, 2376 bp, Homo sapiens
tgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctcttgctcctgtcctctcagctgtggccaccgtcggcatcacgattggagtgctggccagggtggctctgatatagcagccctggtgtattttcgatatttcaggaagactggcagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataactaaa

SEQ ID NO: 46 - DNA, 3004 bp, Homo sapiens
tgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctatggcccagatgtccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggtaagtggatccatgaagcactagcatcacattttcaggtggagtctggctctcagagaagagccaggaagaaattttctttcccaacctgtgtccaaggggcacacgcaaatcccaaattctcccctgaaccctcccaattcacctctgcagactcttttccccttgtttttttgttttttgttgttttttgttttttgatttctcatgtctgactttgggtccatcctggaatgagaggagggggctccctcagcactgagccctgtgtagtgaaaggggcttcacagagaaaaaaggaggaagggtcctcagggtcaagttcctgctctctgtcaccaacaattccctttctgtcacttctttgtgttcttttacctactccataagctacaagggacaaggaggttttgaaatgagctcacactttttccttaaatgagaagaggaagccccttgggtgatggaggagcagctcagactctgcccccatctctgctcccagcacccccagtgactgactgaccccaccctgaagccacctaaggtggaaccagggcatatggagaaggtgcccaggtgtctgtcctgaatcaggctaaatcaagatgctaatcaacaccaaagcctcccctggatcaggccgcaggaaaatgggaagacatggagcctcatgacagactgctgagctgtgtcctggctctgaagtcactggctgtataagactgtgggcacagcacatgggacacagcacagaggacagcaagtgacgcacacttggagacatagggagattcagccatggggactctgcatggcagggaaggggcagtgccaaaaagtgtgtatttatagagaggataagactaccagccactatgtatctaatataggacttaccttttcaacccttccacgtgtgcaggtccgtagtattaaacacattcccgttgttctgctaccatcaccaccacccacccacagaactctcttcttcctcccaaaatgaaactctgttcccatcaaactcctgggcagagctgcccacctgtgacccacagcctgacccctgaactcacctctagacttgcttctggtctcccgctcaaacccccatccccatcatcacccatctccaggatgtccttaaatagcaaagcctcagaaaaaacacaccttggctgggtggtgtgggactgtgcagctgaaagaaacagcacctgcatgttccaggtgagtaccccaaaagaccaggcagtcagccagtcagggaagaaacaggagaggtgccagaggctgtggctgtcagtcctgtatctgcccaagactcaatgcttctgccctattcacatttgagaaagtctgtacttctcccacacaaagcaggtggcctcgatctccgagccctcagatcgttgtgcatccgtcttctgacacacacacctgccctgggctcttaaggacttgggtggactgaggggtgggagatgccaactctgactgaacgatgcctgcagaggaatcaaaggtgccacacacggcaatcttctctctgttttctgcacagcggagctgcccaagccctcggtcaccagcaacaactccaaccctgtagagttttctacatataagtttaagttatctgtgaacagagataattttacttctttccgatttggatgtctgtttatttgtttgtttgctgcctaatttctccagctaggacttaaaatactatgttgaagagaagtggggcaagcaggcatccttgtcttgctcctggtcttacagggaaagctttcagtctttctccattgagtatccctctattatgttgaggtggtttccttccattcacagagtgtttttatttataaaagaatgttgaattttgtc

SEQ ID NO: 47 - DNA, 1410 bp, Homo sapiens
tgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtataccgtgagtatttccacatgacctctgggtgttgggggtcagttctacttcccacatacgggattgtcaggcctgggttgtgcctgtggccctctctgcattacatcctgtatcagggtttggacatttagtgcaggacacacacgggggagacaaacttccacagatcagaattcctttcctggatccagaccctgcagacactcgctgcagaggaaggacagtctgatggggggactcagcagggcgaggtcagtgtcagacaagcaccccatggtctccccatggacctgaccctgagaaagaccctggagaactggatcagggcctggcctgaggggtccccctagggacccctcagagagaagctcaactcttccctgaactgagcccctgtacaaagccctgtccctggttcctgattccaggtgatcctggggagtctgtgccagggctgtgtggtggcctcttgggcagggctggctgggagcaaggatgtgagctatccaagggccatgactcctggagttggtcaccagccaggtccgagcacccagagcctcatctagctgaggatagggcctcctccttcacttgaggctcagcatggaaaggacagatggaaaaaattactagtgcatgagcccactgccctgggggacacaggttactccctgggaagttcagagtccccaaggggaggaacagagaagagaggatgctcctggcagctccatgtccaccagggatcaggcccagggccctctgtcttggaagcaaataatcatagataactgttcacttgggcagctcctctgtgcagagctgagatcaagtaa

SEQ ID NO: 48 - DNA, 255 bp, Artificial
  Synthetic oligonucleotide
atggcccagatgtccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctg

SEQ ID NO: 49 - DNA, 1896 bp, Artificial
  Synthetic oligonucleotide
gtaagtggatccatgaagcactagcatcacattttcaggtggagtctggctctcagagaagagccaggaagaaattttctttcccaacctgtgtccaaggggcacacgcaaatcccaaattctcccctgaaccctcccaattcacctctgcagactcttttccccttgtttttttgttttttgttgttttttgttttttgatttctcatgtctgactttgggtccatcctggaatgagaggagggggctccctcagcactgagccctgtgtagtgaaaggggcttcacagagaaaaaaggaggaagggtcctcagggtcaagttcctgctctctgtcaccaacaattccctttctgtcacttctttgtgttcttttacctactccataagctacaagggacaaggaggttttgaaatgagctcacactttttccttaaatgagaagaggaagccccttgggtgatggaggagcagctcagactctgcccccatctctgctcccagcacccccagtgactgactgaccccaccctgaagccacctaaggtggaaccagggcatatggagaaggtgcccaggtgtctgtcctgaatcaggctaaatcaagatgctaatcaacaccaaagcctcccctggatcaggccgcaggaaaatgggaagacatggagcctcatgacagactgctgagctgtgtcctggctctgaagtcactggctgtataagactgtgggcacagcacatgggacacagcacagaggacagcaagtgacgcacacttggagacatagggagattcagccatggggactctgcatggcagggaaggggcagtgccaaaaagtgtgtatttatagagaggataagactaccagccactatgtatctaatataggacttaccttttcaacccttccacgtgtgcaggtccgtagtattaaacacattcccgttgttctgctaccatcaccaccacccacccacagaactctcttcttcctcccaaaatgaaactctgttcccatcaaactcctgggcagagctgcccacctgtgacccacagcctgacccctgaactcacctctagacttgcttctggtctcccgctcaaacccccatccccatcatcacccatctccaggatgtccttaaatagcaaagcctcagaaaaaacacaccttggctgggtggtgtgggactgtgcagctgaaagaaacagcacctgcatgttccaggtgagtaccccaaaagaccaggcagtcagccagtcagggaagaaacaggagaggtgccagaggctgtggctgtcagtcctgtatctgcccaagactcaatgcttctgccctattcacatttgagaaagtctgtacttctcccacacaaagcaggtggcctcgatctccgagccctcagatcgttgtgcatccgtcttctgacacacacacctgccctgggctcttaaggacttgggtggactgaggggtgggagatgccaactctgactgaacgatgcctgcagaggaatcaaaggtgccacacacggcaatcttctctctgttttctgcacagcggagctgcccaagccctcggtcaccagcaacaactccaaccctgtagagttttctacatataagtttaagttatctgtgaacagagataattttacttctttccgatttggatgtctgtttatttgtttgtttgctgcctaatttctccagctaggacttaaaatactatgttgaagagaagtggggcaagcaggcatccttgtcttgctcctggtcttacagggaaagctttcagtctttctccattgagtatccctctattatgttgaggtggtttccttccattcacagagtgtttttatttataaaagaatgttgaattttgtc

SEQ ID NO: 50 - DNA, 1410 bp, Artificial
  Synthetic oligonucleotide
attggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataactaaa

SEQ ID NO: 51 - DNA, 214 bp, Artificial
  Synthetic oligonucleotide
tgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacag

SEQ ID NO: 52 - DNA, 360 bp, Artificial
  Synthetic oligonucleotide
cctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacc

SEQ ID NO: 53 - DNA, 836 bp, Artificial
  Synthetic oligonucleotide
gtgagtatttccacatgacctctgggtgttgggggtcagttctacttcccacatacgggattgtcaggcctgggttgtgcctgtggccctctctgcattacatcctgtatcagggtttggacatttagtgcaggacacacacgggggagacaaacttccacagatcagaattcctttcctggatccagaccctgcagacactcgctgcagaggaaggacagtctgatggggggactcagcagggcgaggtcagtgtcagacaagcaccccatggtctccccatggacctgaccctgagaaagaccctggagaactggatcagggcctggcctgaggggtccccctagggacccctcagagagaagctcaactcttccctgaactgagcccctgtacaaagccctgtccctggttcctgattccaggtgatcctggggagtctgtgccagggctgtgtggtggcctcttgggcagggctggctgggagcaaggatgtgagctatccaagggccatgactcctggagttggtcaccagccaggtccgagcacccagagcctcatctagctgaggatagggcctcctccttcacttgaggctcagcatggaaaggacagatggaaaaaattactagtgcatgagcccactgccctgggggacacaggttactccctgggaagttcagagtccccaaggggaggaacagagaagagaggatgctcctggcagctccatgtccaccagggatcaggcccagggccctctgtcttggaagcaaataatcatagataactgttcacttgggcagctcctctgtgcagagctgagatcaagtaa

SEQ ID NO: 54 - DNA, 279 bp, Artificial
  Synthetic oligonucleotide
cggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctct

SEQ ID NO: 55 - DNA, 113 bp, Artificial
  Synthetic oligonucleotide
tgctcctgtcctctcagctgtggccaccgtcggcatcacgattggagtgctggccagggtggctctgatatagcagccctggtgtattttcgatatttcaggaagactggcag

SEQ ID NO: 56 - protein, 344 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDVPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 57 - protein, 324 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDVPTISPSKANYRPGENLNLSCHAASNPPAQYSWFINGTFQQSTQELFIPNITVNNSGSYMCQAHNSATGLNRTTVTMITVSDWTRP

SEQ ID NO: 58 - protein, 256 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLLLLSSQLWPPSASRLECWPGWL

SEQ ID NO: 59 - protein, 390 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDVPTISPSKANYRPGENLNLSCHAASNPPAQYSWFINGTFQQSTQELFIPNITVNNSGSYMCQAHNSATGLNRTTVTMITVSGKWIHEALASHFQVESGSQRRARKKFSFPTCVQGAHANPKFSPEPSQFTSADSFPLVFLFFVVFCFLISHV

SEQ ID NO: 60 - protein, 183 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYREYFHMTSGCWGSVLLPTYGIVRPGLCLWPSLHYILYQGLDI

SEQ ID NO: 61 - DNA, 3544 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgcctttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 62 - DNA, 1584 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacggtaattctataactccttagagggtttccaaagaaaggtcttttgttgttcatgaactaagtgtcaccactgctcatgggcgaagtctttgaaaactctctccagactagagaatgttaactttaaacttaaaagcaagcatcttgagatggcagttgtcttttagtatcttttttccacccttggcctggggccaattggtgcaagattgtgaagttgcaaaaagcacctactgatttcatagtctcatggtacatttttatagcaaatattacctggtttcatttctttattgaacaaatattttctaagtttatattagg

SEQ ID NO: 63 - DNA, 1269 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagaggtcaggggtcaggaggatccagagggtgtggaggacaaatgtgtattagctcaatcccgtggacaaagcaaaatcctgctaggccagttgtcagttaatacagtgatggtctaagctttgcatctaagcttgtgccc

SEQ ID NO: 64 - DNA, 970 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactgtaagtatctcttagaagcttgttgacaccggggtaacatccacccaggattttttggtcaacccatgctggatccgcagatcagaggctctgaacacatgaggagcttaacttgacacctcttgacctgttgctaaggagaagtgatgggagaacgtg

SEQ ID NO: 65 - DNA, 166 bp, Artificial
  Synthetic oligonucleotide
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctg

SEQ ID NO: 66 - DNA, 156 bp, Artificial
  Synthetic oligonucleotide
atcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacact

SEQ ID NO: 67 - DNA, 159 bp, Artificial
  Synthetic oligonucleotide
gtaagtatctcttagaagcttgttgacaccggggtaacatccacccaggattttttggtcaacccatgctggatccgcagatcagaggctctgaacacatgaggagcttaacttgacacctcttgacctgttgctaaggagaagtgatgggagaacgtg

SEQ ID NO: 68 - DNA, 176 bp, Artificial
  Synthetic oligonucleotide
gaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagag

SEQ ID NO: 69 - DNA, 137 bp, Artificial
  Synthetic oligonucleotide
gtcaggggtcaggaggatccagagggtgtggaggacaaatgtgtattagctcaatcccgtggacaaagcaaaatcctgctaggccagttgtcagttaatacagtgatggtctaagctttgcatctaagcttgtgccc

SEQ ID NO: 70 - DNA, 129 bp, Artificial
  Synthetic oligonucleotide
agtttccctacgtataccctggtggttcaagctgctgaccttcaaggtgaggggttaagcacaacagcaacagctgtgatcacagtcactgacaccaacgataatcctccgatcttcaatcccaccacg

SEQ ID NO: 71 - DNA, 323 bp, Artificial
  Synthetic oligonucleotide
gtaattctataactccttagagggtttccaaagaaaggtcttttgttgttcatgaactaagtgtcaccactgctcatgggcgaagtctttgaaaactctctccagactagagaatgttaactttaaacttaaaagcaagcatcttgagatggcagttgtcttttagtatcttttttccacccttggcctggggccaattggtgcaagattgtgaagttgcaaaaagcacctactgatttcatagtctcatggtacatttttatagcaaatattacctggtttcatttctttattgaacaaatattttctaagtttatattagg

SEQ ID NO: 72 - DNA, 144 bp, Artificial
  Synthetic oligonucleotide
gactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaa

SEQ ID NO: 73 - DNA, 157 bp, Artificial
  Synthetic oligonucleotide
aatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggg

SEQ ID NO: 74 - DNA, 484 bp, Artificial
  Synthetic oligonucleotide
gcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctg

SEQ ID NO: 75 - DNA, 120 bp, Artificial
  Synthetic oligonucleotide
ctcattactacactggtgtgtccctctgcctttttttttttttaagacagggtctcattctatcggccaggctggagtgcagtggtgcaatcacagctcactgcagccttgtcctcccag

SEQ ID NO: 76 - DNA, 190 bp, Artificial
  Synthetic oligonucleotide
ccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaag

SEQ ID NO: 77 - DNA, 593 bp, Artificial
  Synthetic oligonucleotide
ctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccag

SEQ ID NO: 78 - DNA, 149 bp, Artificial
  Synthetic oligonucleotide
gtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaac

SEQ ID NO: 79 - DNA, 299 bp, Artificial
  Synthetic oligonucleotide
ttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 80 - DNA, 224 bp, Artificial
  Synthetic oligonucleotide
tgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcag

SEQ ID NO: 81 - DNA, 6 bp, Artificial
  Synthetic oligonucleotide
ctgcag

SEQ ID NO: 82 - DNA, 81 bp, Artificial
  Synthetic oligonucleotide
gcctccgtttctggaatccaagcagaattgctcacatttcccaactcctctcctggcctcagaagacagaagagagactgg

SEQ ID NO: 83 - DNA, 63 bp, Artificial
  Synthetic oligonucleotide
gttattcctcccatcagctgcccagaaaatgaaaaaggcccatttcctaaaaacctggttcag

SEQ ID NO: 84 - DNA, 16 bp, Artificial
  Synthetic oligonucleotide
ctcttctctcacgctg

SEQ ID NO: 85 - DNA, 117 bp, Artificial
  Synthetic oligonucleotide
tgtcatccaacgggaatgcagttgaggatccaatggagattttgatcacggtaaccgatcagaatgacaacaagcccgaattcacccaggaggtctttaaggggtctgtcatggaag

SEQ ID NO: 86 - DNA, 12 bp, Artificial
  Synthetic oligonucleotide
gtgctcttccag

SEQ ID NO: 87 - DNA, 115 bp, Artificial
  Synthetic oligonucleotide
gtctcctcttggctctgccaggagccggagccctgccaccctggctttgacgccgagagctacacgttcacggtgccccggcgccacctggagagaggccgcgtcctgggcagag

SEQ ID NO: 88 - DNA, 73 bp, Artificial
  Synthetic oligonucleotide
gcacagcctgtcgaagcaggattgcaaattcctgccattctggggattcttggaggaattcttgctttgctaa

SEQ ID NO: 89 - DNA, 34 bp, Artificial
  Synthetic oligonucleotide
ttctgattctgctgctcttgctgtttcttcggag

SEQ ID NO: 90 - DNA, 97 bp, Artificial
  Synthetic oligonucleotide
gagagcggtggtcaaagagcccttactgcccccagaggatgacacccgggacaacgtttattactatgatgaagaaggaggcggagaagaggaccag

SEQ ID NO: 91 - DNA, 113 bp, Artificial
  Synthetic oligonucleotide
gctcaagctatccttgcacctcagcctcccaagtagctgggaccacaggcatgcaccactacgcatgactaattttttaaatatttgagacggggtctccctgtgttacccag

SEQ ID NO: 92 - DNA, 74 bp, Artificial
  Synthetic oligonucleotide
gctggtctcaaactcctgggctcaagtgatcctcccatcttggcctcccagagtattgggattacagacatgag

SEQ ID NO: 93 - DNA, 51 bp, Artificial
  Synthetic oligonucleotide
ctggtcttaaactcctggcctcaagcaatccttctgccttggccccccaaa

SEQ ID NO: 94 - DNA, 22 bp, Artificial
  Synthetic oligonucleotide
gtgctgggattgtgggcatgag

SEQ ID NO: 95 - protein, 882 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 96 - protein, 322 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGTACRSRIANSCHSGDSWRNSCFANSDSAALAVSSEESGGQRALTAPRG

SEQ ID NO: 97 - protein, 382 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTVIL

SEQ ID NO: 98 - protein, 373 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDREVRGQEDPEGVEDKCVLAQSRGQSKILLGQLSVNTVMV

SEQ ID NO: 99 - protein, 233 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTVSIS

SEQ ID NO: 100 - DNA, 1362 bp, Homo sapiens
ccaaaatctatgggctgggacagcaaagatgtggcctacgaagagaaaggtctggagaatcagaaggccttcaaatggtggttccaaatccctccagcaaagcccatccatctttagagctcacccgtctccagctacaccccccacccctcccggcccagatcaggcagcggggtcgccctctccaggactctcaaggcagctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagccccccagcccccccgcccgggcttccatataaagtaggggccctagtggaggccgcagcagtagcaccagcggctgcggcggcggagctcctccgaggtccgggtcaccagtctctgctcttcccagcctctccggcgcgctccaagggcttcccgtcgggaccatgcgcggcagtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatgtaggttcaaaaggcaaaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggcaggctgtt

SEQ ID NO: 101 - DNA, 1376 bp, Homo sapiens
ccaaaatctatgggctgggacagcaaagatgtggcctacgaagagaaaggtctggagaatcagaaggccttcaaatggtggttccaaatccctccagcaaagcccatccatctttagagctcacccgtctccagctacaccccccacccctcccggcccagatcaggcagcggggtcgccctctccaggactctcaaggcagctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagccccccagcccccccgcccgggcttccatataaagtaggggccctagtggaggccgcagcagtagcaccagcggctgcggcggcggagctcctccgaggtccgggtcaccagtctctgctcttcccagcctctccggcgcgctccaagggcttcccgtcgggaccatgcgcggcagtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatgtaggttcaaaaggcaaagactctctgctccaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggcaggctgtt

SEQ ID NO: 102 - DNA, 760 bp, Artificial
  Synthetic oligonucleotide
ccaaaatctatgggctgggacagcaaagatgtggcctacgaagagaaaggtctggagaatcagaaggccttcaaatggtggttccaaatccctccagcaaagcccatccatctttagagctcacccgtctccagctacaccccccacccctcccggcccagatcaggcagcggggtcgccctctccaggactctcaaggcagctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagccccccagcccccccgcccgggcttccatataaagtaggggccctagtggaggccgcagcagtagcaccagcggctgcggcggcggagctcctccgaggtccgggtcaccagtctctgctcttcccagcctctccggcgcgctccaagggcttcccgtcgggaccatgcgcggcagtgagctcccgctggtcctgctggcgctggtcctctgcctggcgccccgggggcgagcggtcccgctgcctgcgggcggagggaccgtgctgaccaagatgtacccgcgcggcaaccactgggcggtgg

SEQ ID NO: 103 - DNA, 224 bp, Artificial
  Synthetic oligonucleotide
ggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagat

SEQ ID NO: 104 - DNA, 359 bp, Artificial
  Synthetic oligonucleotide
gttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggcaggctgtt

SEQ ID NO: 105 - DNA, 19 bp, Artificial
  Synthetic oligonucleotide
gtaggttcaaaaggcaaag

SEQ ID NO: 106 - DNA, 14 bp, Artificial
  Synthetic oligonucleotide
actctctgctccag

SEQ ID NO: 107 - protein, 148 aa, Homo sapiens
MRGSELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKVGRLSAPGSQREGRNPQLNQQ

SEQ ID NO: 108 - protein, 141 aa, Homo sapiens [sequence omitted]

SEQ ID NO: 109 - protein, 142 aa, Homo sapiens
MRGSELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKDSLLQVLNVKEGTPS

SEQ ID NO: 110 - DNA, 1295 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccggttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttatacc

SEQ ID NO: 111 - DNA, 1367 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 112 - DNA, 1520 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 113 - DNA, 1371 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacagggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 114 - DNA, 2213 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttatacc

SEQ ID NO: 115 - DNA, 2247 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggtgagaatacccagaggccagcagccgaggccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttatacc

SEQ ID NO: 116 - DNA, 153 bp, Artificial
  Synthetic oligonucleotide
acactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctccca

SEQ ID NO: 117 - DNA, 744 bp, Artificial
  Synthetic oligonucleotide
ggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 118 - DNA, 174 bp, Artificial
  Synthetic oligonucleotide
gtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactg

SEQ ID NO: 119 - DNA, 309 bp, Artificial
  Synthetic oligonucleotide
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgt

SEQ ID NO: 120 - DNA, 487 bp, Artificial
  Synthetic oligonucleotide
gtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgc

SEQ ID NO: 121 - DNA, 418 bp, Artificial
  Synthetic oligonucleotide
ggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttataccagttgatgtctgttaattttaaaaaaatgttttcattggtgtttgtttgcgtatccagaaagcagttcatgttatccataaatctggttttgtctttttttgttttaaagaaaaagatgtatacatacagtatagctgcattagataaagcagtgtttgtattttaaaggatgtctgcacaa

SEQ ID NO: 122 - DNA, 44 bp, Artificial
  Synthetic oligonucleotide
gctttgcgctgcaaatccagtgctaccagtgtgaagaattccag

SEQ ID NO: 123 - DNA, 94 bp, Artificial
  Synthetic oligonucleotide
ctgaacaacgactgctcctcccccgagttcattgtgaattgcacggtgaacgttcaagacatgtgtcagaaagaagtgatggagcaaagtgccg

SEQ ID NO: 124 - DNA, 4 bp, Artificial
  Synthetic oligonucleotide
acag

SEQ ID NO: 125 - DNA, 58 bp, Artificial
  Synthetic oligonucleotide
ggatcatgtaccgcaagtcctgtgcatcatcagcggcctgtctcatcgcctctgccgg

SEQ ID NO: 126 - DNA, 11 bp, Artificial
  Synthetic oligonucleotide
ctgaagctgaa

SEQ ID NO: 127 - DNA, 63 bp, Artificial
  Synthetic oligonucleotide
ggagatgccaccccctcctgcattgttcttccagccctcgcccccaaccccccacctccctga

SEQ ID NO: 128 - DNA, 30 bp, Artificial
  Synthetic oligonucleotide
tctgaaaagtgcttaagaaaatcttctcag

SEQ ID NO: 129 - DNA, 84 bp, Artificial
  Synthetic oligonucleotide
ttctccttgcagaggactggcgccgggacgcgaagagcaacgggcgctgcacaaagcgggcgctgtcggtggtggagtgcgcat

SEQ ID NO: 130 - DNA, 26 bp, Artificial
  Synthetic oligonucleotide
gtacgcgcaggcgcttctcgtggttg

SEQ ID NO: 131 - DNA, 113 bp, Artificial
  Synthetic oligonucleotide
gcgtgctgcagcgacaggcggcagcacagcacctgcacgaacacccgccgaaactgctgcgaggacaccgtgtacaggagcgggttgatgaccgagctgaggtagaaaaacgt

SEQ ID NO: 132 - DNA, 82 bp, Artificial
  Synthetic oligonucleotide
ctccgagaaggggaggaggatcatgtacgcccggaagtaggacctcgtccagtcgtgcttgggtttggccgcagccatgatc

SEQ ID NO: 133 - DNA, 24 bp, Artificial
  Synthetic oligonucleotide
ctccgaatctggttgggcatccag

SEQ ID NO: 134 - DNA, 28 bp, Artificial
  Synthetic oligonucleotide
catacggccaatgtcacaacaatcagcc

SEQ ID NO: 135 - DNA, 10 bp, Artificial
  Synthetic oligonucleotide
ctccgcggca

SEQ ID NO: 136 - DNA, 21 bp, Artificial
  Synthetic oligonucleotide
ctgggcagacacgagcaggag

SEQ ID NO: 137 - DNA, 52 bp, Artificial
  Synthetic oligonucleotide
gcagcgcgggccccagcagcctcggcagccacagccgctgcagccggggcag

SEQ ID NO: 138 - DNA, 43 bp, Artificial
  Synthetic oligonucleotide
cctccgctgctgtcgcctcctctgatgcgcttgccctctcccg

SEQ ID NO: 139 - DNA, 32 bp, Artificial
  Synthetic oligonucleotide
gccccgggactccgggagaatgtgggtcctag

SEQ ID NO: 140 - DNA, 39 bp, Artificial
  Synthetic oligonucleotide
gcatcgcggcaactttttgcggattgttcttgcttccag

SEQ ID NO: 141 - DNA, 34 bp, Artificial
  Synthetic oligonucleotide
gtgagaatacccagaggccagcagccgaggccag

SEQ ID NO: 142 - protein, 112 aa, Homo sapiens
MYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 143 - protein, 222 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGSPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 144 - protein, 93 aa, Homo sapiens
MWVLGIAATFCGLFLLPGFALQIQCYQCEEFQLNNDCSSPEFIVNCTVNVQDMCQKEVMEQSAGSHCVTRLECSGTISAHCNLCLPGSNDHPT

SEQ ID NO: 145 - protein, 84 aa, Homo sapiens
MWVLGIAATFCGLFLLPGFALQIQCYQCEEFQLNNDCSSPEFIVNCTVNVQDMCQKEVMEQSADTKRTNTLLFEMRHFAKQLTT

SEQ ID NO: 146 - protein, 90 aa, Homo sapiens
MWVLGIAATFCGLFLLPGFALQIQCYQCEEFQLNNDCSSPEFIVNCTVNVQDMCQKEVMEQSADRVSLCHEAGVQWNNFSTLQPLPPRLK

SEQ ID NO: 147 - DNA, 902 bp, Homo sapiens
ttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggaggcacggtggctcacgcctgtaatcccagcactttgggaggccgagacgggcggatcacgaggtcaagagatggagaccatcccggctaacacgttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatg

SEQ ID NO: 148 - DNA, 1239 bp, Homo sapiens
ttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggagttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccatcaaaatcaaaagtttctc

SEQ ID NO: 149 - DNA, 1020 bp, Homo sapiens
ttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccatcaaaatcaaaagtttctc

SEQ ID NO: 150 - DNA, 178 bp, Artificial
  Synthetic oligonucleotide
ttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcag

SEQ ID NO: 151 - DNA, 780 bp, Artificial
  Synthetic oligonucleotide
ttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccatcaaaatcaaaagtttctc

SEQ ID NO: 152 - DNA, 93 bp, Artificial
  Synthetic oligonucleotide
gcacggtggctcacgcctgtaatcccagcactttgggaggccgagacgggcggatcacgaggtcaagagatggagaccatcccggctaacacg

SEQ ID NO: 153 - DNA, 6 bp, Artificial
  Synthetic oligonucleotide
attcag

SEQ ID NO: 154 - DNA, 56 bp, Artificial
  Synthetic oligonucleotide
aagaggaaatgaaagcattagaagcagatttcttgaccaatatgcatacatcaaag

SEQ ID NO: 155 - DNA, 115 bp, Artificial
  Synthetic oligonucleotide
attagtaaagcacatgttccctcttggaagatgactctgctaaatgtttgcagtcttgtaaataatttgaacagcccagctgaggaaacaggagaagttcatgaagaggagcttg

SEQ ID NO: 156 - DNA, 34 bp, Artificial
  Synthetic oligonucleotide
ttgcaagaaggaaacttcctactgctttagatgg

SEQ ID NO: 157 - DNA, 26 bp, Artificial
  Synthetic oligonucleotide
ctttagcttggaagcaatgttgacaa

SEQ ID NO: 158 - DNA, 8 bp, Artificial
  Synthetic oligonucleotide
tataccag

SEQ ID NO: 159 - DNA, 42 bp, Artificial
  Synthetic oligonucleotide
ctccacaaaatctgtcacagcagggcttttcaacactgggag

SEQ ID NO: 160 - protein, 170 aa, Artificial
  Synthetic peptide
MMAGMKIQLVCMLLLAFSSWSLCSDSEEEMKALEADFLTNMHTSKISKAHVPSWKMTLLNVCSLVNNLNSPAEETGEVHEEELVARRKLPTALDGFSLEAMLTIYQLHKICHSRAFQHWELIQEDILDTGNDKNGKEEVIKRKIPYILKRQLYENKPRRPYILKRDSYYY

SEQ ID NO: 161 - protein, 201 aa, Homo sapiens
MMAGMKIQLVCMLLLAFSSWSLCSDSEEEMKALEADFLTNMHTSKISKAHVPSWKMTLLNVCSLVNNLNSPAEETGEVHEEELVARRKLPTALDGFSLEAMLTIYQLHKICHSRAFQHWEARWLTPVIPALWEAETGGSRGQEMETIPANTLIQEDILDTGNDKNGKEEVIKRKIPYILKRQLYENKPRRPYILKRDSYYY

SEQ ID NO: 162 - protein, 168 aa, Homo sapiens
MMAGMKIQLVCMLLLAFSSWSLCSEEEMKALEADFLTNMHTSKISKAHVPSWKMTLLNVCSLVNNLNSPAEETGEVHEEELVARRKLPTALDGFSLEAMLTIYQLHKICHSRAFQHWELIQEDILDTGNDKNGKEEVIKRKIPYILKRQLYENKPRRPYILKRDSYYY

SEQ ID NO: 163 - protein, 95 aa, Homo sapiens
MMAGMKIQLVCMLLLAFSSWSLCSDSEEEMKALEADFLTNMHTSKLIQEDILDTGNDKNGKEEVIKRKIPYILKRQLYENKPRRPYILKRDSYYY

SEQ ID NO: 164 - DNA, 2873 bp, Homo sapiens
acttcattcacttgcaaatcagtgtgtgcccacaagagccagctctcccgagcccgtaaccttcgcatcccaagagctgcagtttcagccgcgacagcaagaacggcagagccggcgaccgcggcggcggcggcggcggaggcaggagcagcctgggcgggtcgcagggtctccgcgggcgcaggaaggcgagcagagatatcctctgagagccaagcaaagaacattaaggaaggaaggaggaatgaggctggatacggtgcagtgaaaaaggcacttccaagagtggggcactcactacgcacagactcgacggtgccatcagcatgagaacttaccgctacttcttgctgctcttttgggtgggccagccctacccaactctctcaactccactatcaaagaggactagtggtttcccagcaaagaaaagggccctggagctctctggaaacagcaaaaatgagctgaaccgttcaaaaaggagctggatgtggaatcagttctttctcctggaggaatacacaggatccgattatcagtatgtgggcaagttacattcagaccaggatagaggagatggatcacttaaatatatcctttcaggagatggagcaggagatctcttcattattaatgaaaacacaggcgacatacaggccaccaagaggctggacagggaagaaaaacccgtttacatccttcgagctcaagctataaacagaaggacagggagacccgtggagcccgagtctgaattcatcatcaagatccatgacatcaatgacaatgaaccaatattcaccaaggaggtttacacagccactgtccctgaaatgtctgatgtcggtacatttgttgtccaagtcactgcgacggatgcagatgatccaacatatgggaacagtgctaaagttgtctacagtattctacagggacagccctatttttcagttgaatcagaaacaggtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccagagtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaagctcttggactttgaaaagaagaaagtgtatacccttaaagtggaagcctccaatccttatgttgagccacgatttctctacttggggcctttcaaagattcagccacggttagaattgtggtggaggatgtagatgagccacctgtcttcagcaaactggcctacatcttacaaataagagaagatgctcagataaacaccacaataggctccgtcacagcccaagatccagatgctgccaggaatcctgtcaagtactctgtagatcgacacacagatatggacagaatattcaacattgattctggaaatggttcgatttttacatcgaaacttcttgaccgagaaacactgctatggcacaacattacagtgatagcaacagagatcaataatccaaagcaaagtagtcgagtacctctatatattaaagttctagatgtcaatgacaacgccccagaatttgctgagttctatgaaacttttgtctgtgaaaaagcaaaggcagatcagttgattcagaccttgcatgctgttgacaaggatgacccttatagtgggcaccaattttcgttttccttggcccctgaagcagccagtggctcaaactttaccattcaagacaacaaaggtaaatgagttcaagttaccttctctatctatctccatctatatccgtaactgtttctgtatgtatatgtgtatatgtatatgtacatatctgtatctatatctatcttttcttatcacagttgatttaatacatgacgcagtatccacatacattcaccactttgctttccggttccagacaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccacgcggaggcgctcatccaccccacgggactgagcacgggggctctggttgccatccttctgtgcatcgtgatcctactaggtaaactggttctccctgcctcctatctccccatggtgaggggctcacactgttactgtgacactctagatttatctgcctcccccattaaggcatacagcctgatctaggtgagtcgagttacatactgagaatctgtgctgtacgatgtgaactcatttttgcttgcaaatggctttggaaaatgaacagatgtgaaacttgctcgtgtctttgcttgcccaggaagcaaagaatctcttgtctatcagactgggaatgaatctcgggggatttcagggcaacataaatgtgcccttttcatttcattcgttgtgtaatttttttacttggaaaacgttgttaagtgtctggcatggagtgtatgatgagggccctttctataaaggtaaagtttaaagatctatgggaaagtgggaagaggagtatgatgacttttctctcatcctagaaaaataaaaactatgaaatttttttaacccaaa

SEQ ID NO: 165 - DNA, 2893 bp, Homo sapiens
acttcattcacttgcaaatcagtgtgtgcccacaagagccagctctcccgagcccgtaaccttcgcatcccaagagctgcagtttcagccgcgacagcaagaacggcagagccggcgaccgcggcggcggcggcggcggaggcaggagcagcctgggcgggtcgcagggtctccgcgggcgcaggaaggcgagcagagatatcctctgagagccaagcaaagaacattaaggaaggaaggaggaatgaggctggatacggtgcagtgaaaaaggcacttccaagagtggggcactcactacgcacagactcgacggtgccatcagcatgagaacttaccgctacttcttgctgctcttttgggtgggccagccctacccaactctctcaactccactatcaaagaggactagtggtttcccagcaaagaaaagggccctggagctctctggaaacagcaaaaatgagctgaaccgttcaaaaaggagctggatgtggaatcagttctttctcctggaggaatacacaggatccgattatcagtatgtgggcaagttacattcagaccaggatagaggagatggatcacttaaatatatcctttcaggagatggagcaggagatctcttcattattaatgaaaacacaggcgacatacaggccaccaagaggctggacagggaagaaaaacccgtttacatccttcgagctcaagctataaacagaaggacagggagacccgtggagcccgagtctgaattcatcatcaagatccatgacatcaatgacaatgaaccaatattcaccaaggaggtttacacagccactgtccctgaaatgtctgatgtcggtacatttgttgtccaagtcactgcgacggatgcagatgatccaacatatgggaacagtgctaaagttgtctacagtattctacagggacagccctatttttcagttgaatcagaaacaggtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccagagtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaagctcttggactttgaaaagaagaaagtgtatacccttaaagtggaagcctccaatccttatgttgagccacgatttctctacttggggcctttcaaagattcagccacggttagaattgtggtggaggatgtagatgagccacctgtcttcagcaaactggcctacatcttacaaataagagaagatgctcagataaacaccacaataggctccgtcacagcccaagatccagatgctgccaggaatcctgtcaagtactctgtagatcgacacacagatatggacagaatattcaacattgattctggaaatggttcgatttttacatcgaaacttcttgaccgagaaacactgctatggcacaacattacagtgatagcaacagagatcaataatccaaagcaaagtagtcgagtacctctatatattaaagttctagatgtcaatgacaacgccccagaatttgctgagttctatgaaacttttgtctgtgaaaaagcaaaggcagatcagcgttttggtttttctcttagttgattcagaccttgcatgctgttgacaaggatgacccttatagtgggcaccaattttcgttttccttggcccctgaagcagccagtggctcaaactttaccattcaagacaacaaaggtaaatgagttcaagttaccttctctatctatctccatctatatccgtaactgtttctgtatgtatatgtgtatatgtatatgtacatatctgtatctatatctatcttttcttatcacagttgatttaatacatgacgcagtatccacatacattcaccactttgctttccggttccagacaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccacgcggaggcgctcatccaccccacgggactgagcacgggggctctggttgccatccttctgtgcatcgtgatcctactaggtaaactggttctccctgcctcctatctccccatggtgaggggctcacactgttactgtgacactctagatttatctgcctcccccattaaggcatacagcctgatctaggtgagtcgagttacatactgagaatctgtgctgtacgatgtgaactcatttttgcttgcaaatggctttggaaaatgaacagatgtgaaacttgctcgtgtctttgcttgcccaggaagcaaagaatctcttgtctatcagactgggaatgaatctcgggggatttcagggcaacataaatgtgcccttttcatttcattcgttgtgtaatttttttacttggaaaacgttgttaagtgtctggcatggagtgtatgatgagggccctttctataaaggtaaagtttaaagatctatgggaaagtgggaagaggagtatgatgacttttctctcatcctagaaaaataaaaactatgaaatttttttaacccaaa

SEQ ID NO: 166 - DNA, 3998 bp, Homo sapiens
acttcattcacttgcaaatcagtgtgtgcccacaagagccagctctcccgagcccgtaaccttcgcatcccaagagctgcagtttcagccgcgacagcaagaacggcagagccggcgaccgcggcggcggcggcggcggaggcaggagcagcctgggcgggtcgcagggtctccgcgggcgcaggaaggcgagcagagatatcctctgagagccaagcaaagaacattaaggaaggaaggaggaatgaggctggatacggtgcagtgaaaaaggcacttccaagagtggggcactcactacgcacagactcgacggtgccatcagcatgagaacttaccgctacttcttgctgctcttttgggtgggccagccctacccaactctctcaactccactatcaaagaggactagtggtttcccagcaaagaaaagggccctggagctctctggaaacagcaaaaatgagctgaaccgttcaaaaaggagctggatgtggaatcagttctttctcctggaggaatacacaggatccgattatcagtatgtgggcaagttacattcagaccaggatagaggagatggatcacttaaatatatcctttcaggagatggagcaggagatctcttcattattaatgaaaacacaggcgacatacaggccaccaagaggctggacagggaagaaaaacccgtttacatccttcgagctcaagctataaacagaaggacagggagacccgtggagcccgagtctgaattcatcatcaagatccatgacatcaatgacaatgaaccaatattcaccaaggaggtttacacagccactgtccctgaaatgtctgatgtcggtacatttgttgtccaagtcactgcgacggatgcagatgatccaacatatgggaacagtgctaaagttgtctacagtattctacagggacagccctatttttcagttgaatcagaaacaggtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccagagtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaagctcttggactttgaaaagaagaaagtgtatacccttaaagtggaagcctccaatccttatgttgagccacgatttctctacttggggcctttcaaagattcagccacggttagaattgtggtggaggatgtagatgagccacctgtcttcagcaaactggcctacatcttacaaataagagaagatgctcagataaacaccacaataggctccgtcacagcccaagatccagatgctgccaggaatcctgtcaagtactctgtagatcgacacacagatatggacagaatattcaacattgattctggaaatggttcgatttttacatcgaaacttcttgaccgagaaacactgctatggcacaacattacagtgatagcaacagagatcaataatccaaagcaaagtagtcgagtacctctatatattaaagttctagatgtcaatgacaacgccccagaatttgctgagttctatgaaacttttgtctgtgaaaaagcaaaggcagatcagcgttttggtttttctcttagttgattcagaccttgcatgctgttgacaaggatgacccttatagtgggcaccaattttcgttttccttggcccctgaagcagccagtggctcaaactttaccattcaagacaacaaagacaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccacgcggaggcgctcatccaccccacgggactgagcacgggggctctggttgccatccttctgtgcatcgtgatcctactagtgacagtggtgctgtttgcagctctgaggcggcagcgaaaaaaagagcctttgatcatttccaaagaggacatcagagataacattgtcagttacaacgacgaaggtggtggagaggaggacacccaggcttttgatatcggcaccctgaggaatcctgaagccatagaggacaacaaattacgaagggacattgtgcccgaagcccttttcctaccccgacggactccaacagctcgcgacaacaccgatgtcagagatttcattaaccaaaggttaaaggaaaatgacacggaccccactgccccgccatacgactccttggccacttacgcctatgaaggcactggctccgtggcggattccctgagctcgctggagtcagtgaccacggatgcagatcaagactatgattaccttagtgactggggacctcgattcaaaaagcttgcagatatgtatggaggagtggacagtgacaaagactcctaatctgttgcctttttcattttccaatacgacactgaaatatgtgaagtggctatttctttatatttatccactactccgtgaaggcttctctgttctacccgttccaaaagccaatggctgcagtccgtgtggatccaatgttagagacttttttctagtacacttttatgagcttccaaggggcaaatttttattttttagtgcatccagttaaccaagtcagcccaacaggcaggtgccggaggggaggacagggaacagtatttccacttgttctcagggcagcgtgcccgcttccgctgtcctggtgttttactacactccatgtcaggtcagccaactgccctaactgtacatttcacaggctaatgggataaaggactgtgctttaaagataaaaatatcatcatagtaaaagaaatgagggcatatcggctcacaaagagataaactacataggggtgtttatttgtgtcacaaagaatttaaaataacacttgcccatgctatttgttcttcaagaactttctctgccatcaactactattcaaaacctcaaatccacccatatgttaaaattctcattactcttaaggaatagaagcaaattaaacggtaacatccaaaagcaaccacaaacctagtacgacttcattccttccactaactcatagtttgttatatcctagactagacatgcgaaagtttgcctttgtaccatataaagggggagggaaatagctaataatgttaaccaaggaaatatattttaccatacatttaaagttttggccaccacatgtatcacgggtcacttgaaattctttcagctatcagtaggctaatgtcaaaattgtttaaaaattcttgaaagaattttcctgagacaaattttaacttcttgtctatagttgtcagtattattctactatactgtacatgaaagtagcagtgtgaagtacaataattcatattcttcatatccttcttacacgactaagttgaattagtaaagttagattaaataaaacttaaatctcactctaggagttcagtggagaggttagagccagccacacttgaacctaataccctgcccttgacatctggaaacctctacatatttatataacgtgatacatttggataaacaacattgagattatgatgaaaacctacatattccatgtttggaagacccttggaagaggaaaattggattcccttaaacaaaagtgtttaagattgtaattaaaatgatagttgattttcaaaagca

SEQ ID NO: 167 - DNA, 1625 bp, Homo sapiens
acttcattcacttgcaaatcagtgtgtgcccacaagagccagctctcccgagcccgtaaccttcgcatcccaagagctgcagtttcagccgcgacagcaagaacggcagagccggcgaccgcggcggcggcggcggcggaggcaggagcagcctgggcgggtcgcagggtctccgcgggcgcaggaaggcgagcagagatatcctctgagagccaagcaaagaacattaaggaaggaaggaggaatgaggctggatacggtgcagtgaaaaaggcacttccaagagtggggcactcactacgcacagactcgacggtgccatcagcatgagaacttaccgctacttcttgctgctcttttgggtgggccagccctacccaactctctcaactccactatcaaagaggactagtggtttcccagcaaagaaaagggccctggagctctctggaaacagcaaaaatgagctgaaccgttcaaaaaggagctggatgtggaatcagttctttctcctggaggaatacacaggatccgattatcagtatgtgggcaagttacattcagaccaggatagaggagatggatcacttaaatatatcctttcaggagatggagcaggagatctcttcattattaatgaaaacacaggcgacatacaggccaccaagaggctggacagggaagaaaaacccgtttacatccttcgagctcaagctataaacagaaggacagggagacccgtggagcccgagtctgaattcatcatcaagatccatgacatcaatgacaatgaaccaatattcaccaaggaggtttacacagccactgtccctgaaatgtctgatgtcggtacatttgttgtccaagtcactgcgacggatgcagatgatccaacatatgggaacagtgctaaagttgtctacagtattctacagggacagccctatttttcagttgaatcagaaacaggtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccagagtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaaggtaatgccgcttcttaaacaccatacagagtgaacccatttacttttctccagttcctaagttaccaggggcaattatatctcacataaacattcctttagatttttattttacttattattttcagaaaaatgccagttctggccgggcatggtggctcccgcctgtaatcccagcacttttgggggccaaggcaggaggatctcttgagtcctggagtttgagaccaacatggcaaaacctatctctgttaaaaatacaaaaattagccaggcgtggtggtgggtgcctgtaatccca

SEQ ID NO: 168 - DNA, 198 bp, Artificial
  Synthetic oligonucleotide
acttcattcacttgcaaatcagtgtgtgcccacaagagccagctctcccgagcccgtaaccttcgcatcccaagagctgcagtttcagccgcgacagcaagaacggcagagccggcgaccgcggcggcggcggcggcggaggcaggagcagcctgggcgggtcgcagggtctccgcgggcgcaggaaggcgagcagag

SEQ ID NO: 169 - DNA, 168 bp, Artificial
  Synthetic oligonucleotide
gtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccaga

SEQ ID NO: 170 - DNA, 188 bp, Artificial
  Synthetic oligonucleotide
gtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaag

SEQ ID NO: 171 - DNA, 300 bp, Artificial
  Synthetic oligonucleotide
gtaatgccgcttcttaaacaccatacagagtgaacccatttacttttctccagttcctaagttaccaggggcaattatatctcacataaacattcctttagatttttattttacttattattttcagaaaaatgccagttctggccgggcatggtggctcccgcctgtaatcccagcacttttgggggccaaggcaggaggatctcttgagtcctggagtttgagaccaacatggcaaaacctatctctgttaaaaatacaaaaattagccaggcgtggtggtgggtgcctgtaatccca

SEQ ID NO: 172 - DNA, 254 bp, Artificial
  Synthetic oligonucleotide
ctcttggactttgaaaagaagaaagtgtatacccttaaagtggaagcctccaatccttatgttgagccacgatttctctacttggggcctttcaaagattcagccacggttagaattgtggtggaggatgtagatgagccacctgtcttcagcaaactggcctacatcttacaaataagagaagatgctcagataaacaccacaataggctccgtcacagcccaagatccagatgctgccaggaatcctgtcaa

SEQ ID NO: 173 - DNA, 137 bp, Artificial
  Synthetic oligonucleotide
gtactctgtagatcgacacacagatatggacagaatattcaacattgattctggaaatggttcgatttttacatcgaaacttcttgaccgagaaacactgctatggcacaacattacagtgatagcaacagagatca

SEQ ID NO: 174 - DNA, 122 bp, Artificial
  Synthetic oligonucleotide
ataatccaaagcaaagtagtcgagtacctctatatattaaagttctagatgtcaatgacaacgccccagaatttgctgagttctatgaaacttttgtctgtgaaaaagcaaaggcagatcag

SEQ ID NO: 175 - DNA, 180 bp, Artificial
  Synthetic oligonucleotide
gtaaatgagttcaagttaccttctctatctatctccatctatatccgtaactgtttctgtatgtatatgtgtatatgtatatgtacatatctgtatctatatctatcttttcttatcacagttgatttaatacatgacgcagtatccacatacattcaccactttgctttccggttccag

SEQ ID NO: 176 - DNA, 252 bp, Artificial
  Synthetic oligonucleotide
acaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccacgcggaggcgctcatccaccccacgggactgagcacgggggctctggttgccatccttctgtgcatcgtgatcctactag

SEQ ID NO: 177 - DNA, 485 bp, Artificial
  Synthetic oligonucleotide
gtaaactggttctccctgcctcctatctccccatggtgaggggctcacactgttactgtgacactctagatttatctgcctcccccattaaggcatacagcctgatctaggtgagtcgagttacatactgagaatctgtgctgtacgatgtgaactcatttttgcttgcaaatggctttggaaaatgaacagatgtgaaacttgctcgtgtctttgcttgcccaggaagcaaagaatctcttgtctatcagactgggaatgaatctcgggggatttcagggcaacataaatgtgcccttttcatttcattcgttgtgtaatttttttacttggaaaacgttgttaagtgtctggcatggagtgtatgatgagggccctttctataaaggtaaagtttaaagatctatgggaaagtgggaagaggagtatgatgacttttctctcatcctagaaaaataaaaactatgaaatttttttaacccaaa

SEQ ID NO: 178 - DNA, 2313 bp, Artificial
  Synthetic oligonucleotide
tgacagtggtgctgtttgcagctctgaggcggcagcgaaaaaaagagcctttgatcatttccaaagaggacatcagagataacattgtcagttacaacgacgaaggtggtggagaggaggacacccaggcttttgatatcggcaccctgaggaatcctgaagccatagaggacaacaaattacgaagggacattgtgcccgaagcccttttcctaccccgacggactccaacagctcgcgacaacaccgatgtcagagatttcattaaccaaaggttaaaggaaaatgacacggaccccactgccccgccatacgactccttggccacttacgcctatgaaggcactggctccgtggcggattccctgagctcgctggagtcagtgaccacggatgcagatcaagactatgattaccttagtgactggggacctcgattcaaaaagcttgcagatatgtatggaggagtggacagtgacaaagactcctaatctgttgcctttttcattttccaatacgacactgaaatatgtgaagtggctatttctttatatttatccactactccgtgaaggcttctctgttctacccgttccaaaagccaatggctgcagtccgtgtggatccaatgttagagacttttttctagtacacttttatgagcttccaaggggcaaatttttattttttagtgcatccagttaaccaagtcagcccaacaggcaggtgccggaggggaggacagggaacagtatttccacttgttctcagggcagcgtgcccgcttccgctgtcctggtgttttactacactccatgtcaggtcagccaactgccctaactgtacatttcacaggctaatgggataaaggactgtgctttaaagataaaaatatcatcatagtaaaagaaatgagggcatatcggctcacaaagagataaactacataggggtgtttatttgtgtcacaaagaatttaaaataacacttgcccatgctatttgttcttcaagaactttctctgccatcaactactattcaaaacctcaaatccacccatatgttaaaattctcattactcttaaggaatagaagcaaattaaacggtaacatccaaaagcaaccacaaacctagtacgacttcattccttccactaactcatagtttgttatatcctagactagacatgcgaaagtttgcctttgtaccatataaagggggagggaaatagctaataatgttaaccaaggaaatatattttaccatacatttaaagttttggccaccacatgtatcacgggtcacttgaaattctttcagctatcagtaggctaatgtcaaaattgtttaaaaattcttgaaagaattttcctgagacaaattttaacttcttgtctatagttgtcagtattattctactatactgtacatgaaagtagcagtgtgaagtacaataattcatattcttcatatccttcttacacgactaagttgaattagtaaagttagattaaataaaacttaaatctcactctaggagttcagtggagaggttagagccagccacacttgaacctaataccctgcccttgacatctggaaacctctacatatttatataacgtgatacatttggataaacaacattgagattatgatgaaaacctacatattccatgtttggaagacccttggaagaggaaaattggattcccttaaacaaaagtgtttaagattgtaattaaaatgatagttgattttcaaaagcattaattttttttcattgtttttaactttgctttcatgaccatcctgccatccttgactttgaactaatgataaagtaatgatctcaaactatgacagaaaagtaatgtaaaatccatccaatctattatttctctaattatgcaattagcctcatagttattatccagaggacccaactgaactgaactaatccttctggcagattcaaatcgtttatttcacacgctgttctaatggcacttatcattagaatcttaccttgtgcagtcatcagaaattccagcgtactataatgaaaacatccttgttttgaaaacctaaaagacaggctctgtatatatatatacttaagaatatgctgacttcacttattagtcttagggatttattttcaattaatattaattttctacaaataattttagtgtcatttccatttggggatattgtcatatcagcacatattttctgtttggaaacacactgttgtttagttaagttttaaataggtgtattacccaagaagtaaagatggaaacgtt

SEQ ID NO: 179 - DNA, 356 bp, Artificial
  Synthetic oligonucleotide
atatcctctgagagccaagcaaagaacattaaggaaggaaggaggaatgaggctggatacggtgcagtgaaaaaggcacttccaagagtggggcactcactacgcacagactcgacggtgccatcagcatgagaacttaccgctacttcttgctgctcttttgggtgggccagccctacccaactctctcaactccactatcaaagaggactagtggtttcccagcaaagaaaagggccctggagctctctggaaacagcaaaaatgagctgaaccgttcaaaaaggagctggatgtggaatcagttctttctcctggaggaatacacaggatccgattatcagtatgtgggcaag

SEQ ID NO: 180 - DNA, 295 bp, Artificial
  Synthetic oligonucleotide
ttacattcagaccaggatagaggagatggatcacttaaatatatcctttcaggagatggagcaggagatctcttcattattaatgaaaacacaggcgacatacaggccaccaagaggctggacagggaagaaaaacccgtttacatccttcgagctcaagctataaacagaaggacagggagacccgtggagcccgagtctgaattcatcatcaagatccatgacatcaatgacaatgaaccaatattcaccaaggaggtttacacagccactgtccctgaaatgtctgatgtcg

SEQ ID NO: 181 - DNA, 120 bp, Artificial
  Synthetic oligonucleotide
gtacatttgttgtccaagtcactgcgacggatgcagatgatccaacatatgggaacagtgctaaagttgtctacagtattctacagggacagccctatttttcagttgaatcagaaacag

SEQ ID NO: 182 - DNA, 20 bp, Artificial
  Synthetic oligonucleotide
cgttttggtttttctcttag

SEQ ID NO: 183 - DNA, 118 bp, Artificial
  Synthetic oligonucleotide
ttgattcagaccttgcatgctgttgacaaggatgacccttatagtgggcaccaattttcgttttccttggcccctgaagcagccagtggctcaaactttaccattcaagacaacaaag

SEQ ID NO: 184 - protein, 790 aa, Homo sapiens
MRTYRYFLLLFWVGQPYPTLSTPLSKRTSGFPAKKRALELSGNSKNELNRSKRSWMWNQFFLLEEYTGSDYQYVGKLHSDQDRGDGSLKYILSGDGAGDLFIINENTGDIQATKRLDREEKPVYILRAQAINRRTGRPVEPESEFIIKIHDINDNEPIFTKEVYTATVPEMSDVGTFVVQVTATDADDPTYGNSAKVVYSILQGQPYFSVESETGIIKTALLNMDRENREQYQVVIQAKDMGGQMGGLSGTTTVNITLTDVNDNPPRFPQSTYQFKTPESSPPGTPIGRIKASDADVGENAEIEYSITDGEGLDMFDVITDQETQEGIITVKKLLDFEKKKVYTLKVEASNPYVEPRFLYLGPFKDSATVRIVVEDVDEPPVFSKLAYILQIREDAQINTTIGSVTAQDPDAARNPVKYSVDRHTDMDRIFNIDSGNGSIFTSKLLDRETLLWHNITVIATEINNPKQSSRVPLYIKVLDVNDNAPEFAEFYETFVCEKAKADQLIQTLHAVDKDDPYSGHQFSFSLAPEAASGSNFTIQDNKDNTAGILTRKNGYNRHEMSTYLLPVVISDNDYPVQSSTGTVTVRVCACDHHGNMQSCHAEALIHPTGLSTGALVAILLCIVILLVTVVLFAALRRQRKKEPLIISKEDIRDNIVSYNDEGGGEEDTQAFDIGTLRNPEAIEDNKLRRDIVPEALFLPRRTPTARDNTDVRDFINQRLKENDTDPTAPPYDSLATYAYEGTGSVADSLSSLESVTTDADQDYDYLSDWGPRFKKLADMYGGVDSDKDS

SEQ ID NO: 185 - protein, 545 aa, Homo sapiens
MRTYRYFLLLFWVGQPYPTLSTPLSKRTSGFPAKKRALELSGNSKNELNRSKRSWMWNQFFLLEEYTGSDYQYVGKLHSDQDRGDGSLKYILSGDGAGDLFIINENTGDIQATKRLDREEKPVYILRAQAINRRTGRPVEPESEFIIKIHDINDNEPIFTKEVYTATVPEMSDVGTFVVQVTATDADDPTYGNSAKVVYSILQGQPYFSVESETGIIKTALLNMDRENREQYQVVIQAKDMGGQMGGLSGTTTVNITLTDVNDNPPRFPQSTYQFKTPESSPPGTPIGRIKASDADVGENAEIEYSITDGEGLDMFDVITDQETQEGIITVKKLLDFEKKKVYTLKVEASNPYVEPRFLYLGPFKDSATVRIVVEDVDEPPVFSKLAYILQIREDAQINTTIGSVTAQDPDAARNPVKYSVDRHTDMDRIFNIDSGNGSIFTSKLLDRETLLWHNITVIATEINNPKQSSRVPLYIKVLDVNDNAPEFAEFYETFVCEKAKADQLIQTLHAVDKDDPYSGHQFSFSLAPEAASGSNFTIQDNKGK

SEQ ID NO: 186 - protein, 511 aa, Homo sapiens
MRTYRYFLLLFWVGQPYPTLSTPLSKRTSGFPAKKRALELSGNSKNELNRSKRSWMWNQFFLLEEYTGSDYQYVGKLHSDQDRGDGSLKYILSGDGAGDLFIINENTGDIQATKRLDREEKPVYILRAQAINRRTGRPVEPESEFIIKIHDINDNEPIFTKEVYTATVPEMSDVGTFVVQVTATDADDPTYGNSAKVVYSILQGQPYFSVESETGIIKTALLNMDRENREQYQVVIQAKDMGGQMGGLSGTTTVNITLTDVNDNPPRFPQSTYQFKTPESSPPGTPIGRIKASDADVGENAEIEYSITDGEGLDMFDVITDQETQEGIITVKKLLDFEKKKVYTLKVEASNPYVEPRFLYLGPFKDSATVRIVVEDVDEPPVFSKLAYILQIREDAQINTTIGSVTAQDPDAARNPVKYSVDRHTDMDRIFNIDSGNGSIFTSKLLDRETLLWHNITVIATEINNPKQSSRVPLYIKVLDVNDNAPEFAEFYETFVCEKAKADQRFGFSLS

SEQ ID NO: 187 - protein, 343 aa, Homo sapiens
MRTYRYFLLLFWVGQPYPTLSTPLSKRTSGFPAKKRALELSGNSKNELNRSKRSWMWNQFFLLEEYTGSDYQYVGKLHSDQDRGDGSLKYILSGDGAGDLFIINENTGDIQATKRLDREEKPVYILRAQAINRRTGRPVEPESEFIIKIHDINDNEPIFTKEVYTATVPEMSDVGTFVVQVTATDADDPTYGNSAKVVYSILQGQPYFSVESETGIIKTALLNMDRENREQYQVVIQAKDMGGQMGGLSGTTTVNITLTDVNDNPPRFPQSTYQFKTPESSPPGTPIGRIKASDADVGENAEIEYSITDGEGLDMFDVITDQETQEGIITVKKVMPLLKHHTE

SEQ ID NO: 188 - DNA, 2499 bp, Homo sapiens
tgccaggctctccacccccacttcccaattgaggaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctggtgagtccccagaactctgcccggcaaggtgggtccgtgtgctggcgctcactgtccacccaccgtgtccccagggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtaatat

SEQ ID NO: 189 - DNA, 251 bp, Artificial
  Synthetic oligonucleotide
gtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccag

SEQ ID NO: 190 - DNA, 121 bp, Artificial
  Synthetic oligonucleotide
cctctcccctcgccaactccttggcttcccgtgtgcggaggtgtccggcctgagcacggagcgtgtccgggagctggctgtggccttggcacagaagaatgtcaagctctcaacagagcag

SEQ ID NO: 191 - DNA, 179 bp, Artificial
  Synthetic oligonucleotide
agacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgag

SEQ ID NO: 192 - DNA, 156 bp, Artificial
  Synthetic oligonucleotide
ctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcag

SEQ ID NO: 193 - DNA, 193 bp, Artificial
  Synthetic oligonucleotide
gacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtaatat

SEQ ID NO: 194 - DNA, 57 bp, Artificial
  Synthetic oligonucleotide
tgccaggctctccacccccacttcccaattgaggaaaccgaggcagaggaggctcag

SEQ ID NO: 195 - DNA, 44 bp, Artificial
  Synthetic oligonucleotide
gatgggtgcagccctcgaggaccctggctggagagacagggcag

SEQ ID NO: 196 - DNA, 50 bp, Artificial
  Synthetic oligonucleotide
gaggctgcgcccctggacggagtcctggccaacccacctaacatttccag

SEQ ID NO: 197 - DNA, 80 bp, Artificial
  Synthetic oligonucleotide
ctgcgctgtctggctcaccggctctctgagccccccgaggacctggacgccctcccattggacctgctgctattcctcaa

SEQ ID NO: 198 - DNA, 60 bp, Artificial
  Synthetic oligonucleotide
cgccacgcactcctctttctgcctggccggccactcccgtctgctgtgacgcgcggacag

SEQ ID NO: 199 - DNA, 106 bp, Artificial
  Synthetic oligonucleotide
cccagatgcgttctcggggccccaggcctgcacccgtttcttctcccgcatcacgaaggccaatgtggacctgctcccgaggggggctcccgagcgacagcggctg

SEQ ID NO: 200 - DNA, 24 bp, Artificial
  Synthetic oligonucleotide
ctgcctgcggctctggcctgctgg

SEQ ID NO: 201 - DNA, 114 bp, Artificial
  Synthetic oligonucleotide
ggtgtgcgggggtctctgctgagcgaggctgatgtgcgggctctgggaggcctggcttgcgacctgcctgggcgctttgtggccgagtcggccgaagtgctgctaccccggctg

SEQ ID NO: 202 - DNA, 80 bp, Artificial
  Synthetic oligonucleotide
gtgagctgcccgggacccctggaccaggaccagcaggaggcagccagggcggctctgcagggcgggggacccccctacgg

SEQ ID NO: 203 - DNA, 91 bp, Artificial
  Synthetic oligonucleotide
ccccccgtcgacatggtctgtctccacgatggacgctctgcggggcctgctgcccgtgctgggccagcccatcatccgcagcatcccgcag

SEQ ID NO: 204 - DNA, 100 bp, Artificial
  Synthetic oligonucleotide
ggcatcgtggccgcgtggcggcaacgctcctctcgggacccatcctggcggcagcctgaacggaccatcctccggccgcggttccggcgggaagtggaga

SEQ ID NO: 205 - DNA, 42 bp, Artificial
  Synthetic oligonucleotide
agagctaccggtggacccacggtgcctccctccctgggatct

SEQ ID NO: 206 - DNA, 30 bp, Artificial
  Synthetic oligonucleotide
gtggccaccctgatcgaccgctttgtgaag

SEQ ID NO: 207 - DNA, 74 bp, Artificial
  Synthetic oligonucleotide
ggaaggggccagctagacaaagacaccctagacaccctgaccgccttctaccctgggtacctgtgctccctcag

SEQ ID NO: 208 - DNA, 39 bp, Artificial
  Synthetic oligonucleotide
ccccgaggagctgagctccgtgccccccagcagcatctg

SEQ ID NO: 209 - DNA, 74 bp, Artificial
  Synthetic oligonucleotide
gtgagtccccagaactctgcccggcaaggtgggtccgtgtgctggcgctcactgtccacccaccgtgtccccag

SEQ ID NO: 210 - DNA, 43 bp, Artificial
  Synthetic oligonucleotide
ggcggtcaggccccaggacctggacacgtgtgacccaaggcag

SEQ ID NO: 211 - DNA, 21 bp, Artificial
  Synthetic oligonucleotide
ctggacgtcctctatcccaag

SEQ ID NO: 212 - DNA, 18 bp, Artificial
  Synthetic oligonucleotide
gcccgccttgctttccag

SEQ ID NO: 213 - DNA, 24 bp, Artificial
  Synthetic oligonucleotide
aacatgaacgggtccgaatacttc

SEQ ID NO: 214 - DNA, 18 bp, Artificial
  Synthetic oligonucleotide
gtgaagatccagtccttc

SEQ ID NO: 215 - DNA, 4 bp, Artificial
  Synthetic oligonucleotide
ctgg

SEQ ID NO: 216 - DNA, 38 bp, Artificial
  Synthetic oligonucleotide
gtggggcccccacggaggatttgaaggcgctcagtcag

SEQ ID NO: 217 - DNA, 57 bp, Artificial
  Synthetic oligonucleotide
cagaatgtgagcatggacttggccacgttcatgaagctgcggacggatgcggtgctg

SEQ ID NO: 218 - DNA, 24 bp, Artificial
  Synthetic oligonucleotide
ccgttgactgtggctgaggtgcag

SEQ ID NO: 219 - DNA, 27 bp, Artificial
  Synthetic oligonucleotide
aaacttctgggaccccacgtggagggc

SEQ ID NO: 220 - DNA, 57 bp, Artificial
  Synthetic oligonucleotide
ctgaaggcggaggagcggcaccgcccggtgcgggactggatcctacggcagcggcag

SEQ ID NO: 221 - DNA, 79 bp, Artificial
  Synthetic oligonucleotide
gacgacctggacacgctggggctggggctacagggcggcatccccaacggctacctggtcctagacctcagcatgcaag

SEQ ID NO: 222 - DNA, 30 bp, Artificial
  Synthetic oligonucleotide
aggccctctcggggacgccctgcctcctag

SEQ ID NO: 223 - DNA, 54 bp, Artificial
  Synthetic oligonucleotide
acacagaccatggccttgccaacggctcgacccctgttggggtcctgtgggacc

SEQ ID NO: 224 - DNA, 40 bp, Artificial
  Synthetic oligonucleotide
cccgccctcggcagcctcctgttcctgctcttcagcctcg

SEQ ID NO: 225 - protein, 628 aa, Homo sapiens
MALQRLDPCWSCGDRPGSLLFLLFSLGWVHPARTLAGETGTESAPLGGVLTTPHNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVDKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSVQETLSGTPCLLGPGPVLTVLALLLASTLA

SEQ ID NO: 226 - protein, 458 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIW

SEQ ID NO: 227 - DNA, 2658 bp, Homo sapiens
agggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtgagaaagcccctccctgctatctgattaggttaaaacacacaagatcatcattgttctaggtcagaaatggtcaaatgtcagcaaatctctaatactcaatataaaaccataaaggaagatctagctctcttataagtgacatgggtcacgcattcctagtgtgaaccccctcttctctattaaacaaacggggtggttctcttgtcctttttgcatgtgatacttgttttcaaaaaaatgacaagggattggttctacagacccaccttgattgcttcatttctaacttctttgtcttccatctctttcacattttctgtaaacgtatcagtgatgtgcagagctcactcacactggctcataaaagctgttttttgtttttatttttgtttttgtttgttttgagaaagagtctcagtctgtggcccaggctggagtgcagtggcactgtcttggctcactgcaacctctacctccaggttcaagcgattcttctgcctcagcctcccaagtagctgggactatagtcgtgcgccaccacacccagctaacttttgtatttttagtagatacggggtttcaccatgttggccaggctggtctcgaactcctgacctgaggtaatcctcctgccttggcctcccaaagtgctgggattacaggcatgagccactgcacctggcagagagctgactgttaagtgttcaggcattttgtgagctgatgtgaaacagatccgttataaaaaaatagaattaaattaacataattaaataaattatttttaaaacaaaggtaataaatactcaaaactcatcacttcctaattattttactgttgcctgtgctttcagggttatttgtgttgtcgtgtctgtatggagggaataatataaaggtgtgctgctgcccaactccacattcagtcacctggtgttggtagcttgaaatcaaccgtggtgggattatttacatccactatggaagtgggcagacgctataagtcagggctttcccctctaccactggaccggtttttaatatttactcgcacaccactgatgtgtctgcattcccaatctctgccttgagtccaaatatacagtatctagacccactgctcaggatctgagaactgcagtcatttttcctacacccccacccctcggctgcagacaaccaggacagggtctaatggctccctattctttctggtttgggttccactcccactaggtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcagtgagtgagccccactttcctttttcttcctcctccagcaccttcgttgtttcctgggtagtctgcctgggtgaggctcccttcctgtttctcatctgtggcttctgaaacacttagactctggacccagcaagagtttcaggaagtgggttgctaggcagttagacaggcttgttggtgaacacccggtatgtagttccatttcagcacaataaaaagaaatcttgcattcaagatgctaaattgtttttaacgaagg

SEQ ID NO: 228 - DNA, 5914 bp, Homo sapiens
acggagtctcactgtgtcgccaggctgtagtgcagtggtgtgatctcagctcactgcaacctctgcctccggggctcaagtgattctcctgcctcagcctcccgagtagctgggattacagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccaacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatggcaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacccattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagatccttcatcatcctggaagagccttttgccatgcaagacaacatagccacaggtggggattaggaccaggacatctttggggtgctgttattctgcctaccacaccttcctgccactgactcccacaggagaggctacaaaatgatctggcgcacagggatgttttgtttagcttgcggactctaacacttaaaaaaaaccccagatcagaagatctggccatgctggggctcacattctcacctagcaacaactggctggagctgggcaccagctctgcctttagaaggggtgtccacttcaccaggtcaccacagcccacactacgccctatcacttcccacaatgaggctgagtgtttgtttctactgatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgttgcctaggctggagtgcagtggcgcaatctcggctcactgcaacctctgcctcctgggctcaagcaattctcccacctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaatgaaaggaattttatagtctcctaaatggcgtgtactgcaagacctcttgaacactttccagaggataggatatttaagtcatgcccttggcgttgcctatggcacctttcccttctgaaagtctggttcctgcccagtgacccttggccttgtgagccgagatgctgaccctgcataaagggccaaaggagggctgcggcttccttccctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacataaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaagggaaaggtctcaaggaagagtcaactgggacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtaccaaaaaacaagtatcaagctgtttaagtgcttcggctacttgtcccctggttcagtagaggccccggtttcccagttgttgactgtgacaggctcagcatgggctcagcagatgctgtcttaatttgtggatgatacagaaagccaggctttgggatacaagttctttcctcttcatttgatgccgtgcactgtgtgaagcagatgtttttgtccggaaataaaaataatagtcttggagtctcgccacca

SEQ ID NO: 229 - DNA, 1785 bp, Homo sapiens
agggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagtacgcccctgaatcagtgcatttgtccctggccatggatagctcttctctccccgccttgccttagtggggttccctgggtaggttgtaaatcatatcaaaaaggcccatctggccgggcacgatggctcacgcctgtaatcccagcactttgggaggccaaggctggtggatcacttgaggtcaggagttcaagaccagcctggccaacgtggtaaaaccccatctttactaaaaatacaaaaattagctgggcatggtggcaggcgcctataatctcagctgctcagaaggctgaagcaggagaatggcctgaacctgggaggcggaggttgcagtgagccgagattgcaccacgcactctagcctgggcaacagagtaagactcaaaaaaaacaaaaaa

SEQ ID NO: 230 - DNA, 5285 bp, Homo sapiens
ggctggagtgcagtgagccgagatcgcaccacttcactccagcctgggcaatagagtgagactcggtctcaaaaaaaaaaaatgtttgatgactgaaggccagtaaaccaacagccacctccttgctgggctaccatgacttctgatgtgtgctcttagttcaaatgcaggaactaaggccacaagaggcaaagtagcctgcccaagaacaccctattaggaagtggcagagccagaagacgaactaacatctccccaacgccactcacagctccaaccactgcccagaactgcctcctgagcaacacgtctgggtggagtgaaacctgtgccctgccccatgacacttagcatctaagacacagatacacagaagaaaaacttaagcaaaaaaggagaggaaatttcaaccctgagtactacccagaagtttgtttgccagcttagtaaacagtaagaatgtttactaagagagcagagggaccgctagaaaaggaacacagaggagccagaagcagagggcagggtgggagaagagagaccgaagggaaacacagggcagcatgcagacacccaacctcaggctgacgggagagctggggagggtgcacttctggtctcctttgtgcatggctagcatgccccacttcttccaggctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccaacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatggcaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacccattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagatccttcatcatcctggaagagccttttgccatgcaagacaacatagccacaggtggggattaggaccaggacatctttggggtgctgttattctgcctaccacaccttcctgccactgactcccacaggagaggctacaaaatgatctggcgcacagggatgttttgtttagcttgcggactctaacacttaaaaaaaaccccagatcagaagatctggccatgctggggctcacattctcacctagcaacaactggctggagctgggcaccagctctgcctttagaaggggtgtccacttcaccaggtcaccacagcccacactacgccctatcacttcccacaatgaggctgagtgtttgtttctactgatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgttgcctaggctggagtgcagtggcgcaatctcggctcactgcaacctctgcctcctgggctcaagcaattctcccacctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaatgaaaggaattttatagtctcctaaatggcgtgtactgcaagacctcttgaacactttccagaggataggatatttaagtcatgcccttggcgttgcctatggcacctttcccttctgaaagtctggttcctgcccagtgacccttggccttgtgagccgagatgctgaccctgcataaagggccaaaggagggctgcggcttccttccctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacataaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaagggaaaggtctcaaggaagagtcaactgggacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtaccaaaaaacaagtatcaagctgtttaagtgcttcggctacttgtcccctggttcagtagaggccccggtttcccagttgttgactgtgacaggctcagcatgggctcagcagatgctgtcttaatttgtggatgatacagaaagccaggctttgggatacaagttctttcctcttcatttgatgccgtgcactgtgtgaagcagatgtttttgtccggaaataaaaataatagtcttggagtctcgccacca

SEQ ID NO: 231 - DNA, 218 bp, Artificial
  Synthetic oligonucleotide
agggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcag

SEQ ID NO: 232 - DNA, 222 bp, Artificial
  Synthetic oligonucleotide
ataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataa

SEQ ID NO: 233 - DNA, 403 bp, Artificial
  Synthetic oligonucleotide
gtacgcccctgaatcagtgcatttgtccctggccatggatagctcttctctccccgccttgccttagtggggttccctgggtaggttgtaaatcatatcaaaaaggcccatctggccgggcacgatggctcacgcctgtaatcccagcactttgggaggccaaggctggtggatcacttgaggtcaggagttcaagaccagcctggccaacgtggtaaaaccccatctttactaaaaatacaaaaattagctgggcatggtggcaggcgcctataatctcagctgctcagaaggctgaagcaggagaatggcctgaacctgggaggcggaggttgcagtgagccgagattgcaccacgcactctagcctgggcaacagagtaagactcaaaaaaaacaaaaaa

SEQ ID NO: 234 - DNA, 656 bp, Artificial
  Synthetic oligonucleotide
ggctggagtgcagtgagccgagatcgcaccacttcactccagcctgggcaatagagtgagactcggtctcaaaaaaaaaaaatgtttgatgactgaaggccagtaaaccaacagccacctccttgctgggctaccatgacttctgatgtgtgctcttagttcaaatgcaggaactaaggccacaagaggcaaagtagcctgcccaagaacaccctattaggaagtggcagagccagaagacgaactaacatctccccaacgccactcacagctccaaccactgcccagaactgcctcctgagcaacacgtctgggtggagtgaaacctgtgccctgccccatgacacttagcatctaagacacagatacacagaagaaaaacttaagcaaaaaaggagaggaaatttcaaccctgagtactacccagaagtttgtttgccagcttagtaaacagtaagaatgtttactaagagagcagagggaccgctagaaaaggaacacagaggagccagaagcagagggcagggtgggagaagagagaccgaagggaaacacagggcagcatgcagacacccaacctcaggctgacgggagagctggggagggtgcacttctggtctcctttgtgcatggctagcatgccccacttcttccag

SEQ ID NO: 235 - DNA, 381 bp, Artificial
  Synthetic oligonucleotide
gctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccaacaagaggcctccaggcagggtctgacggtgtcctttataccttatttcaaag

SEQ ID NO: 236 - DNA, 366 bp, Artificial
  Synthetic oligonucleotide
aggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtgg

SEQ ID NO: 237 - DNA, 121 bp, Artificial
  Synthetic oligonucleotide
acggagtctcactgtgtcgccaggctgtagtgcagtggtgtgatctcagctcactgcaacctctgcctccggggctcaagtgattctcctgcctcagcctcccgagtagctgggattacag

SEQ ID NO: 238 - DNA, 1975 bp, Artificial
  Synthetic oligonucleotide
gaaaaagaagacaaacaagggccccgctgtgggtatctacaatggcaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacccattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagatccttcatcatcctggaagagccttttgccatgcaagacaacatagccacaggtggggattaggaccaggacatctttggggtgctgttattctgcctaccacaccttcctgccactgactcccacaggagaggctacaaaatgatctggcgcacagggatgttttgtttagcttgcggactctaacacttaaaaaaaaccccagatcagaagatctggccatgctggggctcacattctcacctagcaacaactggctggagctgggcaccagctctgcctttagaaggggtgtccacttcaccaggtcaccacagcccacactacgccctatc

SEQ ID NO: 239 - DNA, 270 bp, Artificial
  Synthetic oligonucleotide
atgaggctgagtgtttgtttctactgatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgttgcctaggctggagtgcagtggcgcaatctcggctcactgcaacctctgcctcctgggctcaagcaattctcccac

SEQ ID NO: 240 - DNA, 410 bp, Artificial
  Synthetic oligonucleotide
ctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaat

SEQ ID NO: 241 - DNA, 489 bp, Artificial
  Synthetic oligonucleotide
ctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacataaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaag

SEQ ID NO: 242 - DNA, 432 bp, Artificial
  Synthetic oligonucleotide
ggaaaggtctcaaggaagagtcaactgggacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtaccaaaaaacaagtatcaagctgtttaagtgcttcggctacttgtcccctggttcagtagaggccccggtttcccagttgttgactgtgacaggctcagcatgggctcagcagatgctgtcttaatttgtggatgatacagaaagccaggctttgggatacaagttctttcctcttcatttgatgccgtgcactgtgtgaagcagatgtttttgtccggaaataaaaataatagtcttggagtctcgccacca

SEQ ID NO: 243 - DNA, 210 bp, Artificial
  Synthetic oligonucleotide
aagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattg

SEQ ID NO: 244 - DNA, 363 bp, Artificial
  Synthetic oligonucleotide
actgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaac

SEQ ID NO: 245 - DNA, 1239 bp, Artificial
  Synthetic oligonucleotide
gtgagaaagcccctccctgctatctgattaggttaaaacacacaagatcatcattgttctaggtcagaaatggtcaaatgtcagcaaatctctaatactcaatataaaaccataaaggaagatctagctctcttataagtgacatgggtcacgcattcctagtgtgaaccccctcttctctattaaacaaacggggtggttctcttgtcctttttgcatgtgatacttgttttcaaaaaaatgacaagggattggttctacagacccaccttgattgcttcatttctaacttctttgtcttccatctctttcacattttctgtaaacgtatcagtgatgtgcagagctcactcacactggctcataaaagctgttttttgtttttatttttgtttttgtttgttttgagaaagagtctcagtctgtggcccaggctggagtgcagtggcactgtcttggctcactgcaacctctacctccaggttcaagcgattcttctgcctcagcctcccaagtagctgggactatagtcgtgcgccaccacacccagctaacttttgtatttttagtagatacggggtttcaccatgttggccaggctggtctcgaactcctgacctgaggtaatcctcctgccttggcctcccaaagtgctgggattacaggcatgagccactgcacctggcagagagctgactgttaagtgttcaggcattttgtgagctgatgtgaaacagatccgttataaaaaaatagaattaaattaacataattaaataaattatttttaaaacaaaggtaataaatactcaaaactcatcacttcctaattattttactgttgcctgtgctttcagggttatttgtgttgtcgtgtctgtatggagggaataatataaaggtgtgctgctgcccaactccacattcagtcacctggtgttggtagcttgaaatcaaccgtggtgggattatttacatccactatggaagtgggcagacgctataagtcagggctttcccctctaccactggaccggtttttaatatttactcgcacaccactgatgtgtctgcattcccaatctctgccttgagtccaaatatacagtatctagacccactgctcaggatctgagaactgcagtcatttttcctacacccccacccctcggctgcagacaaccaggacagggtctaatggctccctattctttctggtttgggttccactcccactag

SEQ ID NO: 246 - DNA, 369 bp, Artificial
  Synthetic oligonucleotide
gtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagca

SEQ ID NO: 247 - DNA, 259 bp, Artificial
  Synthetic oligonucleotide
gtgagtgagccccactttcctttttcttcctcctccagcaccttcgttgtttcctgggtagtctgcctgggtgaggctcccttcctgtttctcatctgtggcttctgaaacacttagactctggacccagcaagagtttcaggaagtgggttgctaggcagttagacaggcttgttggtgaacacccggtatgtagttccatttcagcacaataaaaagaaatcttgcattcaagatgctaaattgtttttaacgaagg

SEQ ID NO: 248 - DNA, 88 bp, Artificial
  Synthetic oligonucleotide
acttgactgtcatcctcatcgcagcggtgggaggtggagtcttactgctgtctgccctcgggctcatcatttgctgtgtgaaaaagaa

SEQ ID NO: 249 - DNA, 10 bp, Artificial
  Synthetic oligonucleotide
acttcccaca

SEQ ID NO: 250 - DNA, 111 bp, Artificial
  Synthetic oligonucleotide
gaaaggaattttatagtctcctaaatggcgtgtactgcaagacctcttgaacactttccagaggataggatatttaagtcatgcccttggcgttgcctatggcacctttcc

SEQ ID NO: 251 - DNA, 97 bp, Artificial
  Synthetic oligonucleotide
cttctgaaagtctggttcctgcccagtgacccttggccttgtgagccgagatgctgaccctgcataaagggccaaaggagggctgcggcttccttcc

SEQ ID NO: 252 - protein, 770 aa, Homo sapiens [sequence omitted]

SEQ ID NO: 253 - protein, 487 aa, Homo sapiens
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESNKIYVVDLSNERAMSLTIEPRPVKQSRKFVPGCFVCLESRTCSSNLTLTSGSKHKISFLCDDLTRLWMNVEKTISTPLNQCICPWPWIALLSPPCLSGVPWVGCKSYQKGPSGRARWLTPVIPALWEAKAGGSLEVRSSRPAWPTW

SEQ ID NO: 254 - protein, 231 aa, Homo sapiens
MIIQEQRTRAEEIFSLDEDVLPKPSFHHHSFWVNISNCSPTSGKQLDLLFSVTLTPRTVDLTVILIAAVGGGVLLLSALGLIICCVKKKKKKTNKGPAVGIYNGNINTEMPRQPKKFQKGRKDNDSHVYAVIEDTMVYGHLLQDSSGSFLQPEVDTYRPFQGTMGVCPPSPPTICSRAPTAKLATEEPPPRSPPESESEPYTFSHPNNGDVSSKDTDIPLLNTQEPMEPAE

SEQ ID NO: 255 - protein, 238 aa, Homo sapiens
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKREKAPPCYLIRLKHTRSSLF

SEQ ID NO: 256 - DNA, 1292 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaaggtaagcaggggatgagggcacactgagctccctccagccctctcagcctcaaccctctggaggcccaggcatatgggcagggggactcctgaaccctactccaagcacagcctctgtctgactcccttgtccttcaagagaactgttctccaggtctcagggccaggatttccataggatcgcctgtggctttgattctattctagtgtctctgggtgggggtcctgggcaagtgtctttctgagtctcagtttctttatcggtaaaatgtacataatgagattgaaagtgctctgcaaagcactatgtgcactaagaatttattattcaggttgtttccatcatgttttctgaggtgaaatcacaaaggatcagtggagtttgaggattatctagttcaatgctttgagtttagagttttacggtgaaaatgagacttgtctcctgacactaagtctctctcaactatagcgctatcttgctattttctctatctcagaaggatccttgggcaggaggaaggatgtggatatgatttggctggtttctatgctgaagctcttatctgattttctctcacagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaacctgcttct

SEQ ID NO: 257 - DNA, 886 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaaggtgaaaagagacatcacaagcaattgagggaccaggaagtggatcctctagagatgaggaggcattctgctggatgacttttaaaaatgttttctccagagtcatctctctcattaacaatgttttttgtcttagaaatttcttgttgatttttaaacttacatgatttcttgttttggtatgaatacaggctgcttcagtccttcaataagcccatcacactttttcaccatgtcatctatcagcactttttctgcagtgttacgaacatcagcttcatcactgtcagcctgcgttttgcctgcaacccatcaaatgaggtcaggagaggagttttccacttttggcttcatgttggtgctcaaaact

SEQ ID NO: 258 - DNA, 696 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaaggctgcttcagtccttcaataagcccatcacactttttcaccatgtcatctatcagcactttttctgcagtgttacgaacatcagcttcatcactgtcagcctgcgttttgcctgcaacccatcaaatgaggtcaggagaggagttttccacttttggcttcatgttggtgctcaaaact

SEQ ID NO: 259 - DNA, 706 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaagaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaacctgcttct

SEQ ID NO: 260 - DNA, 560 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaacctgcttct

SEQ ID NO: 261 - DNA, 582 bp, Artificial
  Synthetic oligonucleotide
gtaagcaggggatgagggcacactgagctccctccagccctctcagcctcaaccctctggaggcccaggcatatgggcagggggactcctgaaccctactccaagcacagcctctgtctgactcccttgtccttcaagagaactgttctccaggtctcagggccaggatttccataggatcgcctgtggctttgattctattctagtgtctctgggtgggggtcctgggcaagtgtctttctgagtctcagtttctttatcggtaaaatgtacataatgagattgaaagtgctctgcaaagcactatgtgcactaagaatttattattcaggttgtttccatcatgttttctgaggtgaaatcacaaaggatcagtggagtttgaggattatctagttcaatgctttgagtttagagttttacggtgaaaatgagacttgtctcctgacactaagtctctctcaactatagcgctatcttgctattttctctatctcagaaggatccttgggcaggaggaaggatgtggatatgatttggctggtttctatgctgaagctcttatctgattttctctcacag

SEQ ID NO: 262 - DNA, 193 bp, Artificial
  Synthetic oligonucleotide
cttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaacctgcttct

SEQ ID NO: 263 - DNA, 190 bp, Artificial
  Synthetic oligonucleotide
gtgaaaagagacatcacaagcaattgagggaccaggaagtggatcctctagagatgaggaggcattctgctggatgacttttaaaaatgttttctccagagtcatctctctcattaacaatgttttttgtcttagaaatttcttgttgatttttaaacttacatgatttcttgttttggtatgaatacag

SEQ ID NO: 264 - DNA, 179 bp, Artificial
  Synthetic oligonucleotide
gctgcttcagtccttcaataagcccatcacactttttcaccatgtcatctatcagcactttttctgcagtgttacgaacatcagcttcatcactgtcagcctgcgttttgcctgcaacccatcaaatgaggtcaggagaggagttttccacttttggcttcatgttggtgctcaaaact

SEQ ID NO: 265 - DNA, 208 bp, Artificial
  Synthetic oligonucleotide
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagt

SEQ ID NO: 266 - DNA, 37 bp, Artificial
  Synthetic oligonucleotide
ccttcaaagctggagtctgtcctcctaagaaatctgc

SEQ ID NO: 267 - DNA, 112 bp, Artificial
  Synthetic oligonucleotide
ccagtgccttagatacaagaaacctgagtgccagagtgactggcagtgtccagggaagaagagatgttgtcctgacacttgtggcatcaaatgcctggatcctgttgacacc

SEQ ID NO: 268 - DNA, 10 bp, Artificial
  Synthetic oligonucleotide
ccaaacccaa

SEQ ID NO: 269 - DNA, 4 bp, Artificial
  Synthetic oligonucleotide
caag

SEQ ID NO: 270 - DNA, 56 bp, Artificial
  Synthetic oligonucleotide
gaggaagcctgggaagtgcccagtgacttatggccaatgtttgatgcttaaccccc

SEQ ID NO: 271 - DNA, 90 bp, Artificial
  Synthetic oligonucleotide
ccaatttctgtgagatggatggccagtgcaagcgtgacttgaagtgttgcatgggcatgtgtgggaaatcctgcgtttcccctgtgaaag

SEQ ID NO: 272 - protein, 132 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKA

SEQ ID NO: 273 - protein, 139 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKGKQGMRAH

SEQ ID NO: 274 - protein, 156 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKGEKRHHKQLRDQEVDPLEMRRHSAG

SEQ ID NO: 275 - protein, 89 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPRGSLGSAQ

SEQ ID NO: 276 - protein, 82 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPT

SEQ ID NO: 277 - DNA, 1846 bp, Homo sapiens
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacaggtatttttaaacttctcataattaaactacagtgatgaaagatagccacactcaggccatttgggctgctcagatgaatcctgcctgcctgctggcaaacatgtgcttaggacattgactgatctgccatgttggcttctctctgtgttaagccatccacagatgaggctgaaaaataaaaactgctttggattaaaaaggttaacttttgaataaaaaagctaggcatgtgtgatgcgcactaacacgtgccattccttcttcagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataaga

SEQ ID NO: 278 - DNA, 1769 bp, Homo sapiens
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagcactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaactttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataaga

SEQ ID NO: 279 - DNA, 378 bp, Homo sapiens
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcaggtaagcatcttttatgtttttatatagttaaatcatttactcaattatggcgagaggtgcaagaaacgtatttgctgcgatattact

SEQ ID NO: 280 - DNA, 184 bp, Artificial
  Synthetic oligonucleotide
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaag

SEQ ID NO: 281 - DNA, 189 bp, Artificial
  Synthetic oligonucleotide
cactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaa

SEQ ID NO: 282 - DNA, 266 bp, Artificial
  Synthetic oligonucleotide
gtatttttaaacttctcataattaaactacagtgatgaaagatagccacactcaggccatttgggctgctcagatgaatcctgcctgcctgctggcaaacatgtgcttaggacattgactgatctgccatgttggcttctctctgtgttaagccatccacagatgaggctgaaaaataaaaactgctttggattaaaaaggttaacttttgaataaaaaagctaggcatgtgtgatgcgcactaacacgtgccattccttcttcag

SEQ ID NO: 283 - DNA, 164 bp, Artificial
  Synthetic oligonucleotide
actgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgag

SEQ ID NO: 284 - DNA, 230 bp, Artificial
  Synthetic oligonucleotide
agtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatc

SEQ ID NO: 285 - DNA, 136 bp, Artificial
  Synthetic oligonucleotide
tggtgtgaataaatcttttatcttgaatgtaataagaatttggtggtgtcaattgcttatttgttttcccacggttgtccagcaattaataaaacataaccttttttactgcctatataatgtttttaaaggttta

SEQ ID NO: 286 - DNA, 26 bp, Artificial
  Synthetic oligonucleotide
gaaaactcactaccatgagaattgca

SEQ ID NO: 287 - DNA, 42 bp, Artificial
  Synthetic oligonucleotide
gtgatttgcttttgcctcctaggcatcacctgtgccatacca

SEQ ID NO: 288 - DNA, 39 bp, Artificial
  Synthetic oligonucleotide
gttaaacaggctgattctggaagttctgaggaaaagcag

SEQ ID NO: 289 - DNA, 87 bp, Artificial
  Synthetic oligonucleotide
gtaagcatcttttatgtttttatatagttaaatcatttactcaattatggcgagaggtgcaagaaacgtatttgctgcgatattact

SEQ ID NO: 290 - DNA, 81 bp, Artificial
  Synthetic oligonucleotide
ctttacaacaaatacccagatgctgtggccacatggctaaaccctgacccatctcagaagcagaatctcctagccccacag

SEQ ID NO: 291 - DNA, 42 bp, Artificial
  Synthetic oligonucleotide
aatgctgtgtcctctgaagaaaccaatgactttaaacaagag

SEQ ID NO: 292 - DNA, 8 bp, Artificial
  Synthetic oligonucleotide
acccttcc

SEQ ID NO: 293 - DNA, 50 bp, Artificial
  Synthetic oligonucleotide
aagtaagtccaacgaaagccatgaccacatggatgatatggatgatgaag

SEQ ID NO: 294 - DNA, 65 bp, Artificial
  Synthetic oligonucleotide
atgatgatgaccatgtggacagccaggactccattgactcgaacgactctgatgatgtagatgac

SEQ ID NO: 295 - DNA, 37 bp, Artificial
  Synthetic oligonucleotide
gtcaaaatctaagaagtttcgcagacctgacatccag

SEQ ID NO: 296 - DNA, 18 bp, Artificial
  Synthetic oligonucleotide
taccctgatgctacagac

SEQ ID NO: 297 - DNA, 26 bp, Artificial
  Synthetic oligonucleotide
gaggacatcacctcacacatggaaag

SEQ ID NO: 298 - DNA, 52 bp, Artificial
  Synthetic oligonucleotide
cgaggagttgaatggtgcatacaaggccatccccgttgcccaggacctgaac

SEQ ID NO: 299 - DNA, 51 bp, Artificial
  Synthetic oligonucleotide
gcgccttctgattgggacagccgtgggaaggacagttatgaaacgagtcag

SEQ ID NO: 300 - DNA, 12 bp, Artificial
  Synthetic oligonucleotide
ctggatgaccag

SEQ ID NO: 301 - DNA, 34 bp, Artificial
  Synthetic oligonucleotide
ttctgaggtcaattaaaaggagaaaaaatacaat

SEQ ID NO: 302 - DNA, 41 bp, Artificial
  Synthetic oligonucleotide
ttctcactttgcatttagtcaaaagaaaaaatgctttatag

SEQ ID NO: 303 - DNA, 36 bp, Artificial
  Synthetic oligonucleotide
caaaatgaaagagaacatgaaatgcttctttctcag

SEQ ID NO: 304 - DNA, 119 bp, Artificial
  Synthetic oligonucleotide
tttattggttgaatgtgtatctatttgagtctggaaataactaatgtgtttgataattagtttagtttgtggcttcatggaaactccctgtaaactaaaagcttcagggttatgtctat

SEQ ID NO: 305 - DNA, 11 bp, Artificial
  Synthetic oligonucleotide
gttcattctat

SEQ ID NO: 306 - DNA, 91 bp, Artificial
  Synthetic oligonucleotide
agaagaaatgcaaactatcactgtattttaatatttgttattctctcatgaatagaaatttatgtagaagcaaacaaaatacttttaccca

SEQ ID NO: 307 - DNA, 18 bp, Artificial
  Synthetic oligonucleotide
cttaaaaagagaatataa

SEQ ID NO: 308 - DNA, 6 bp, Artificial
  Synthetic oligonucleotide
catttt

SEQ ID NO: 309 - DNA, 60 bp, Artificial
  Synthetic oligonucleotide
atgtcactataatcttttgttttttaagttagtgtatattttgttgtgattatctttttg

SEQ ID NO: 310 - protein, 314 aa, Homo sapiens
MRIAVICFCLLGITCAIPVKQADSGSSEEKQLYNKYPDAVATWLNPDPSQKQNLLAPQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 311 - protein, 64 aa, Homo sapiens
MRIAVICFCLLGITCAIPVKQADSGSSEEKQLYNKYPDAVATWLNPDPSQKQNLLAPQVFLNFS

SEQ ID NO: 312 - protein, 32 aa, Homo sapiens
MRIAVICFCLLGITCAIPVKQADSGSSEEKQH

SEQ ID NO: 313 - protein, 39 aa, Homo sapiens
MRIAVICFCLLGITCAIPVKQADSGSSEEKQVSIFYVFI

SEQ ID NO: 314 - DNA, 3750 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggtatgtgcctgaatgtaccccgacccaggtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaacttacctttgtgagtgctagtatctgtgaatttctataaacattatacaggaaggccgttttcatattatagcaggcactatcggggttacatagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtttacatagtgccttcctgcatgcctcactttggattggcgtgatgagagtaaacgtcttgcaagacagggcatttgagcaaggggttgaagaatggcaagggtttatcagatctggggctgtggggtgatcattggggaagggcttgcagaagagctcaaggtgctttcagtgcaatgggagcggttgtgttttgccagagcacctgaatcctgtcaaaagcaggaggtgatgagcttggaaaggtagcagaggccaaattgcaggctttgaatggtggttgactcactttgcaagacaaaggggcagctgcgttttctcgtgtggtattcaagacttcttttcttctcctggacttcaggctgtttttgtacaagagcgcatactcatttctttctctctttttcaaatgtgactaaatcacacttcccagggacaccaagctgtttctgattgcaactgtaacagcctgtgtaccagctgggatttttgtattaagcagctctatggggctactataccagcagaaaattagaagtcttgctctaaaaagcattttcagcaaatacttgttttgttcttaaagtttttactgcctcaatttgtcagctaatggatcagaagtgattgggactgcctggagctttttttcagttatggtcttagatgtgagtcagagaatattatctattgagtttcacccacttctctgcccctgtgcttttacagactgtccttatttttctaggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 315 - DNA, 3144 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagatatgccacatctggaagttaatttttctgccttaaagttgaagaaatcaaagcacaaggaagttaagtaacttgctcagctaataagtagtggaagcaaatctgtcttccaagccgaggctctctccatgacactgggctgctctgcttgattagaactctgccttaccatcaatacccaagcctcctctactaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggcatggccactccttctactctctggggcaggtctggcagatcccagagctctcactgtgacaaagcgctaataaccgtctgctgcccggtggattcaatgttaggcccagggagaatcttgaaattatcagatgaaagattgtattattcttccatctagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 316 - DNA, 2544 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggtatgtgcctgaatgtaccccgacccaggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 317 - DNA, 2575 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtgctaatggatcagaagtgattgggactgcctggagctttttttcagttatggtcttagatgctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 318 - DNA, 3529 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagaggtaaggccagacatgagccagggatctagagtagggttagaaatactcagctctgccggcctagctctttgaagggtaggtggcaaaatgatttgtgttcttaggggcaagtctgacaccctaatctagcccagtacaggaagccagaagcactttgaagtcagaaaagagccttagtggtcagctttgaatgtattacaaccattgtaattgatgccccaatacaatagaatgagagaggaaaattattagctttatgaagatgaaaatgcattcatagatgtggcagaagattaatttgttagctgtgtaaaaattctctgctgctacagagaatcctgccctgccctccccaccctcaacatgtccccgagagctgctcctctgtaaccctcacagctccaggagcttgtcccggaagcacgaggtctgtgttatttcccacagaagctgcagcaggttttgcagaggctcccagcaaggagtatctcctcagtagcctacaccatctccccgggacccagacaaccttagagtcacatggatggtcagacagaccttgacatgagggcagcttgctggcagcttgactttctaaacagaattggaggcaaatttaaatgtcacaaaggtgtttctcattgatttgactttattagaacctgagtgatttcagacacacaaaggccagtaagaacagaattgctttcacctctggaaatcgttttcagatgtgccgctttcttctatccaggacgtttgctggaagaatgtaactcaatagtgtaccctcaacgtggctgccagttagggtgctgggatcagagagaggctttttcagggagaccatcagtgggtgggagaagatgtctcatctccacccgagtctccattgtgagctttctgagcatttcaccatggagactcggcacagacgtgttccttggctttcctgtaggaatccagggcccaccagagcttcccttagcaccagcagtggcagctggttcattttgccaccctccagtagccttttcctggtggttctgcattgtacctgagaaagagccaggactcagttgcttttgcaaagcagaaccctgttcccttgcagcacctgcctgggcccccagggagccaaaagactgctctgctgagttctctcttttctggaagttgctcactcgagaagaatgaaatctgcccgccatggtggcttatgcctataatcccagcactttgggaggctaaggcgggaggatcgcttgagctcaggagttggagaccagcctgggcaacatagtgagacctcgtctctcaaaaaattaata

SEQ ID NO: 319 - DNA, 2433 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 320 - DNA, 4378 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagatatgccacatctggaagttaatttttctgccttaaagttgaagaaatcaaagcacaaggaagttaagtaacttgctcagctaataagtagtggaagcaaatctgtcttccaagccgaggctctctccatgacactgggctgctctgcttgattagaactctgccttaccatcaatacccaagcctcctctactaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggcatggccactccttctactctctggggcaggtctggcagatcccagagctctcactgtgacaaagcgctaataaccgtctgctgcccggtggattcaatgttaggcccagggagaatcttgaaattatcagatgaaagattgtattattcttccatctagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggtatgtgcctgaatgtaccccgacccaggtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaacttacctttgtgagtgctagtatctgtgaatttctataaacattatacaggaaggccgttttcatattatagcaggcactatcggggttacatagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtttacatagtgccttcctgcatgcctcactttggattggcgtgatgagagtaaacgtcttgcaagacagggcatttgagcaaggggttgaagaatggcaagggtttatcagatctggggctgtggggtgatcattggggaagggcttgcagaagagctcaaggtgctttcagtgcaatgggagcggttgtgttttgccagagcacctgaatcctgtcaaaagcaggaggtgatgagcttggaaaggtagcagaggccaaattgcaggctttgaatggtggttgactcactttgcaagacaaaggggcagctgcgttttctcgtgtggtattcaagacttcttttcttctcctggacttcaggctgtttttgtacaagagcgcatactcatttctttctctctttttcaaatgtgactaaatcacacttcccagggacaccaagctgtttctgattgcaactgtaacagcctgtgtaccagctgggatttttgtattaagcagctctatggggctactataccagcagaaaattagaagtcttgctctaaaaagcattttcagcaaatacttgttttgttcttaaagtttttactgcctcaatttgtcagctaatggatcagaagtgattgggactgcctggagctttttttcagttatggtcttagatgtgagtcagagaatattatctattgagtttcacccacttctctgcccctgtgcttttacagactgtccttatttttctaggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 321 - DNA, 3654 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggtatgtgcctgaatgtaccccgacccaggtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaacttacctttgtgagtgctagtatctgtgaatttctataaacattatacaggaaggccgttttcatattatagcaggcactatcggggttacatagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtttacatagtgccttcctgcatgcctcactttggattggcgtgatgagagtaaacgtcttgcaagacagggcatttgagcaaggggttgaagaatggcaagggtttatcagatctggggctgtggggtgatcattggggaagggcttgcagaagagctcaaggtgctttcagtgcaatgggagcggttgtgttttgccagagcacctgaatcctgtcaaaagcaggaggtgatgagcttggaaaggtagcagaggccaaattgcaggctttgaatggtggttgactcactttgcaagacaaaggggcagctgcgttttctcgtgtggtattcaagacttcttttcttctcctggacttcaggctgtttttgtacaagagcgcatactcatttctttctctctttttcaaatgtgactaaatcacacttcccagggacaccaagctgtttctgattgcaactgtaacagcctgtgtaccagctgggatttttgtattaagcagctctatggggctactataccagcagaaaattagaagtcttgctctaaaaagcattttcagcaaatacttgttttgttcttaaagtttttactgcctcaatttgtcagctaatggatcagaagtgattgggactgcctggagctttttttcagttatggtcttagatgtgagtcagagaatattatctattgagtttcacccacttctctgcccctgtgcttttacagactgtccttatttttctaggctgatgtggtcatcaagttccctgaggaagaagctccctcgactgtcttgtcccagaaccttttcactccaaaacaggaaattcagtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 322 - DNA, 2334 bp, Homo sapiens
gtacctgggactatgggtgcatcccaccgcaccccgctgttagctgataatcctgcaggtcagaagtctagacaggcttgcctgggccctctgcttagtgtctcctgaggtcaaagtgaaggcattggccaaactgggctcctcccggaagcactggagaagaatctgcctccaggcccattcatgttgtcgtattgtcagcaaaatccagttcctgtggttgtgggcctgaggtctccatttccttgctagctgtctgctaggagttgctctctgttcctcaaggccattggtatttcttctcacatggcccctccacctttaaaccagtaatggcatgaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 323 - DNA, 2340 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 324 - DNA, 2086 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgcctttggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 325 - DNA, 2244 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 326 - DNA, 1717 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagggccaggtgaggtggctcacacctgtaatcccagcactttgggaggccaaggcaggcggatcacctgaggtcaggagttcaatactagcctggccaacatgatgaaaccccatctctactaaaaacacaaaaagtagccaggcgtggtggcacgtgcctgtaatcccagctactcgggaggctgaagcaggagaatcgcttgaacctgggaggtggaggttgcagtgagctgagatcgtgccaccgcactccagcctgggcaatggagccagactctgtctcaaaaaaataaataaataaataaaataca

SEQ ID NO: 327 - DNA, 1501 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtagggtaagtcctgatcatattttggtggggcgctgacctctttgttttggaaagttagcctgcagccagtgtaacagattaatacattccagttaggtaaatttgatctactggtatcgaaagcctacagtcgaatgtaagaaaatgatttttaaaatgaagattatttggttttactgtttcattctctgtttctagttggc

SEQ ID NO: 328 - DNA, 1522 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 329 - DNA, 1836 bp, Homo sapiens
tgctggctctgtcaccctgccaactcatttaatgcttgtgccttgtgatctgtaaattggatctgtaaacctacctgccttgttgaattctttattttgaaacacctgaaagaaaagctctgggtagttatcaagttttggtccagttctaatgtgcagacaccttggtttcttgtgccattagtggggataaagtgattagactcagtaccatcgtattgctattaactactatttgttgactagctagcatataccgttccctgcactaatgcttagcatatggtattgcaaatcttcacacagatatgccacatctggaagttaatttttctgccttaaagttgaagaaatcaaagcacaaggaagttaagtaacttgctcagctaataagtagtggaagcaaatctgtcttccaagccgaggctctctccatgacactgggctgctctgcttgattagaactctgccttaccatcaatacccaagcctcctctactaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggcatggccactccttctactctctggggcaggtctggcagatcccagagctctcactgtgacaaagcgctaataaccgtctgctgcccggtggattcaatgttaggcccagggagaatcttgaaattatcagatgaaagattgtattattcttccatctagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 330 - DNA, 1275 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcatggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 331 - DNA, 1718 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcgtgagttgtcatctcgagcatttctcaggcttcatttgtctcgggtcctatccgaagagggctcattcattggttcagcaaatactttctgggcaagtacttgcagtaaatacttccgtgtgccaggtgctctgcaaggcaccgcagacatgattgcatgaaggcaagtaaggtccgtgtcctcgtggagctcacatggacacagtcttctgcaagcctcgcagacagaaggcaagcgctgagccagagcatgagcacaccaccacctagagatccagttgccttgtgcggttggagggctagagcaagggcagataactgagaaggagccacgtgcatgtcttgttgaggcttggctagggcaggatgacatgttggcagtggaggctctgcaaagtgggggctctcaggatccctggaagttgtgaaagacagcatctggtgggtgaggtggttgctcagagggtggagtattctaggaatcagactctactactctgcaaaaggcttaggtgaaggagaagcacctttcctatttgttataaatggaaatattgtaacttcagggtgttttttgctaagctcttaaagtgataaatataatgtagttttaaaatttttaatttaatttagagacacggaatctcaactctgtcaacccaaggctgaaagtgcaaatggtaatgaatcaaaactcactgcagccttgaaactctgggctcaaagtgaattttcctaacctcaagcctcccgagtaagctggaactacaaggtgcaaaactaccacagcctagctaatttttttttttttttgagacgtggtcttactctgttacccaggctagagtgcagtgacgcgatctcagttcactgcaacctccgcctcccgggttcaagcagttctcctgcctcagcgtcttcagt

SEQ ID NO: 332 - DNA, 872 bp, Homo sapiens
ttcagtgggggtgtcagttaccttataaatgcagtttctgacctttcagcttcatggtctcacctgttttaaaatagtagggtttgtcatcattaaaaatgatgttcaggtttgagttacacgagcccatttgagagcaggtgctgaatgcctttctaaagaaaaagggaacaagtttccccgagggcttataatagggtggttgtcacttggaagaattgcctgtccttctaggatgcatgaactttgaagccttggggctgttgatgggattagcattggcatggcttgtgttgcttcccttttaagttctaatgcctttttaatttatttctccccatcattcagtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 333 - DNA, 1375 bp, Homo sapiens
ttgagatggagtcttgctctgtctcgcccaggctggagtgcaacggtgcgatcttggctcactgcagcctctgcctcccaggttcaggcgattctcccacctcagcctcccaagtagctgggattataggcctgcgccaccacacctggctaattttatatttttagtagagagagggtttcaccatgttggccagggtggtctcgaatgcctgacctcaagtgatccttctgcctcggcctcccaaagtgctgggattacaggtgtgagctcccgcacccagcctatttatatcctgtgtatttttgttaagaatttgaaaaatgaatgccaagtataacatgacagaggagttttaaacaaaagcagagaaatagttgtaagcaggaacatggcacaggtcgctgaagtccaattgttacccctgtttgtgggtgtgtgtgtgggtgtgtgtgtgttttgagacgaggtatcactgtcacccaggctgaagtacagtggtgtgatcaagctcactgcatccttgacctcccaggctcaagcgatcttcctacctcagcctcctaagtagctaggactacagacatggaccattacgcctgactaattttttgaattttaatagacacgaggtctcactgtgttgcccagggtggtctcgaactcctgagcaatcctcctgcctcagcctcccaaaatgttgggattacaggtgtgagccactgtgcctggccacacacttggccacagctgagaggcgaatatattgagttagctactttttggcatcagagcaaaggaataaaacaagctggtataggagtacagaccttttcatgatccaacagttgctatgtctaactttcctcaaccgcagggcatcattatgtttcatttaattggatgtcatgacacctcttcttgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 334 - DNA, 1602 bp, Homo sapiens
ttgagatggagtcttgctctgtctcgcccaggctggagtgcaacggtgcgatcttggctcactgcagcctctgcctcccaggttcaggcgattctcccacctcagcctcccaagtagctgggattataggcctgcgccaccacacctggctaattttatatttttagtagagagagggtttcaccatgttggccagggtggtctcgaatgcctgacctcaagtgatccttctgcctcggcctcccaaagtgctgggattacaggtgtgagctcccgcacccagcctatttatatcctgtgtatttttgttaagaatttgaaaaatgaatgccaagtataacatgacagaggagttttaaacaaaagcagagaaatagttgtaagcaggaacatggcacaggtcgctgaagtccaattgttacccctgtttgtgggtgtgtgtgtgggtgtgtgtgtgttttgagacgaggtatcactgtcacccaggctgaagtacagtggtgtgatcaagctcactgcatccttgacctcccaggctcaagcgatcttcctacctcagcctcctaagtagctaggactacagacatggaccattacgcctgactaattttttgaattttaatagacacgaggtctcactgtgttgcccagggtggtctcgaactcctgagcaatcctcctgcctcagcctcccaaaatgttgggattacaggtgtgagccactgtgcctggccacacacttggccacagctgagaggcgaatatattgagttagctactttttggcatcagagcaaaggaataaaacaagctggtataggagtacagaccttttcatgatccaacagttgctatgtctaactttcctcaaccgcagggcatcattatgtttcatttaattggatgtcatgacacctcttcttgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaaaaaaaaaagattgagagcttattctcatacttttgggtggtggggtccttgggtatatgacatgaggacttagttggaaatgctgttgatgccagcatatttctccaggcctttcttggtccttcttgccccttgctcctaacagaactgagaactgcctggaaaggccagcttccttttttcttctccagcagtgagcaccagctgtctgcataggagccctgttg

SEQ ID NO: 335 - DNA, 328 bp, Artificial
  Synthetic oligonucleotide
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgg

SEQ ID NO: 336 - DNA, 194 bp, Artificial
  Synthetic oligonucleotide
gttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaag

SEQ ID NO: 337 - DNA, 340 bp, Artificial
  Synthetic oligonucleotide
gtacctgggactatgggtgcatcccaccgcaccccgctgttagctgataatcctgcaggtcagaagtctagacaggcttgcctgggccctctgcttagtgtctcctgaggtcaaagtgaaggcattggccaaactgggctcctcccggaagcactggagaagaatctgcctccaggcccattcatgttgtcgtattgtcagcaaaatccagttcctgtggttgtgggcctgaggtctccatttccttgctagctgtctgctaggagttgctctctgttcctcaaggccattggtatttcttctcacatggcccctccacctttaaaccagtaatggcatg

SEQ ID NO: 338 - DNA, 133 bp, Artificial
  Synthetic oligonucleotide
atctctatttcaaatgagaccaaagatctgcttctggcagctgtcagtgaggactcatctgttacccagatctaccatgcagttgcagctctaagtggctttggccttcccttggcatcccaagaagcactca

SEQ ID NO: 339 - DNA, 924 bp, Artificial
  Synthetic oligonucleotide
gtgagttgtcatctcgagcatttctcaggcttcatttgtctcgggtcctatccgaagagggctcattcattggttcagcaaatactttctgggcaagtacttgcagtaaatacttccgtgtgccaggtgctctgcaaggcaccgcagacatgattgcatgaaggcaagtaaggtccgtgtcctcgtggagctcacatggacacagtcttctgcaagcctcgcagacagaaggcaagcgctgagccagagcatgagcacaccaccacctagagatccagttgccttgtgcggttggagggctagagcaagggcagataactgagaaggagccacgtgcatgtcttgttgaggcttggctagggcaggatgacatgttggcagtggaggctctgcaaagtgggggctctcaggatccctggaagttgtgaaagacagcatctggtgggtgaggtggttgctcagagggtggagtattctaggaatcagactctactactctgcaaaaggcttaggtgaaggagaagcacctttcctatttgttataaatggaaatattgtaacttcagggtgttttttgctaagctcttaaagtgataaatataatgtagttttaaaatttttaatttaatttagagacacggaatctcaactctgtcaacccaaggctgaaagtgcaaatggtaatgaatcaaaactcactgcagccttgaaactctgggctcaaagtgaattttcctaacctcaagcctcccgagtaagctggaactacaaggtgcaaaactaccacagcctagctaatttttttttttttttgagacgtggtcttactctgttacccaggctagagtgcagtgacgcgatctcagttcactgcaacctccgcctcccgggttcaagcagttctcctgcctcagcgtcttcagt

SEQ ID NO: 340 - DNA, 166 bp, Artificial
  Synthetic oligonucleotide
gatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacagg

SEQ ID NO: 341 - DNA, 200 bp, Artificial
  Synthetic oligonucleotide
gtaagtcctgatcatattttggtggggcgctgacctctttgttttggaaagttagcctgcagccagtgtaacagattaatacattccagttaggtaaatttgatctactggtatcgaaagcctacagtcgaatgtaagaaaatgatttttaaaatgaagattatttggttttactgtttcattctctgtttctagttggc

SEQ ID NO: 342 - DNA, 310 bp, Artificial
  Synthetic oligonucleotide
ggccaggtgaggtggctcacacctgtaatcccagcactttgggaggccaaggcaggcggatcacctgaggtcaggagttcaatactagcctggccaacatgatgaaaccccatctctactaaaaacacaaaaagtagccaggcgtggtggcacgtgcctgtaatcccagctactcgggaggctgaagcaggagaatcgcttgaacctgggaggtggaggttgcagtgagctgagatcgtgccaccgcactccagcctgggcaatggagccagactctgtctcaaaaaaataaataaataaataaaataca

SEQ ID NO: 343 - DNA, 306 bp, Artificial
  Synthetic oligonucleotide
tgctggctctgtcaccctgccaactcatttaatgcttgtgccttgtgatctgtaaattggatctgtaaacctacctgccttgttgaattctttattttgaaacacctgaaagaaaagctctgggtagttatcaagttttggtccagttctaatgtgcagacaccttggtttcttgtgccattagtggggataaagtgattagactcagtaccatcgtattgctattaactactatttgttgactagctagcatataccgttccctgcactaatgcttagcatatggtattgcaaatcttcacacag

SEQ ID NO: 344 - DNA, 628 bp, Artificial
  Synthetic oligonucleotide
atatgccacatctggaagttaatttttctgccttaaagttgaagaaatcaaagcacaaggaagttaagtaacttgctcagctaataagtagtggaagcaaatctgtcttccaagccgaggctctctccatgacactgggctgctctgcttgattagaactctgccttaccatcaatacccaagcctcctctactaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggcatggccactccttctactctctggggcaggtctggcagatcccagagctctcactgtgacaaagcgctaataaccgtctgctgcccggtggattcaatgttaggcccagggagaatcttgaaattatcagatgaaagattgtattattcttccatctag

SEQ ID NO: 345 - DNA, 1067 bp, Artificial
  Synthetic oligonucleotide
gtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaacttacctttgtgagtgctagtatctgtgaatttctataaacattatacaggaaggccgttttcatattatagcaggcactatcggggttacatagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtttacatagtgccttcctgcatgcctcactttggattggcgtgatgagagtaaacgtcttgcaagacagggcatttgagcaaggggttgaagaatggcaagggtttatcagatctggggctgtggggtgatcattggggaagggcttgcagaagagctcaaggtgctttcagtgcaatgggagcggttgtgttttgccagagcacctgaatcctgtcaaaagcaggaggtgatgagcttggaaaggtagcagaggccaaattgcaggctttgaatggtggttgactcactttgcaagacaaaggggcagctgcgttttctcgtgtggtattcaagacttcttttcttctcctggacttcaggctgtttttgtacaagagcgcatactcatttctttctctctttttcaaatgtgactaaatcacacttcccagggacaccaagctgtttctgattgcaactgtaacagcctgtgtaccagctgggatttttgtattaagcagctctatggggctactataccagcagaaaattagaagtcttgctctaaaaagcattttcagcaaatacttgttttgttcttaaagtttttactgcctcaatttgtcag

SEQ ID NO: 346 - DNA, 348 bp, Artificial
  Synthetic oligonucleotide
ttcagtgggggtgtcagttaccttataaatgcagtttctgacctttcagcttcatggtctcacctgttttaaaatagtagggtttgtcatcattaaaaatgatgttcaggtttgagttacacgagcccatttgagagcaggtgctgaatgcctttctaaagaaaaagggaacaagtttccccgagggcttataatagggtggttgtcacttggaagaattgcctgtccttctaggatgcatgaactttgaagccttggggctgttgatgggattagcattggcatggcttgtgttgcttcccttttaagttctaatgcctttttaatttatttctccccatcattcag

SEQ ID NO: 347 - DNA, 927 bp, Artificial
  Synthetic oligonucleotide
ttgagatggagtcttgctctgtctcgcccaggctggagtgcaacggtgcgatcttggctcactgcagcctctgcctcccaggttcaggcgattctcccacctcagcctcccaagtagctgggattataggcctgcgccaccacacctggctaattttatatttttagtagagagagggtttcaccatgttggccagggtggtctcgaatgcctgacctcaagtgatccttctgcctcggcctcccaaagtgctgggattacaggtgtgagctcccgcacccagcctatttatatcctgtgtatttttgttaagaatttgaaaaatgaatgccaagtataacatgacagaggagttttaaacaaaagcagagaaatagttgtaagcaggaacatggcacaggtcgctgaagtccaattgttacccctgtttgtgggtgtgtgtgtgggtgtgtgtgtgttttgagacgaggtatcactgtcacccaggctgaagtacagtggtgtgatcaagctcactgcatccttgacctcccaggctcaagcgatcttcctacctcagcctcctaagtagctaggactacagacatggaccattacgcctgactaattttttgaattttaatagacacgaggtctcactgtgttgcccagggtggtctcgaactcctgagcaatcctcctgcctcagcctcccaaaatgttgggattacaggtgtgagccactgtgcctggccacacacttggccacagctgagaggcgaatatattgagttagctactttttggcatcagagcaaaggaataaaacaagctggtataggagtacagaccttttcatgatccaacagttgctatgtctaactttcctcaaccgcagggcatcattatgtttcatttaattggatgtcatgacacctcttcttgctg

SEQ ID NO: 348 - DNA, 1331 bp, Artificial
  Synthetic oligonucleotide
gtaaggccagacatgagccagggatctagagtagggttagaaatactcagctctgccggcctagctctttgaagggtaggtggcaaaatgatttgtgttcttaggggcaagtctgacaccctaatctagcccagtacaggaagccagaagcactttgaagtcagaaaagagccttagtggtcagctttgaatgtattacaaccattgtaattgatgccccaatacaatagaatgagagaggaaaattattagctttatgaagatgaaaatgcattcatagatgtggcagaagattaatttgttagctgtgtaaaaattctctgctgctacagagaatcctgccctgccctccccaccctcaacatgtccccgagagctgctcctctgtaaccctcacagctccaggagcttgtcccggaagcacgaggtctgtgttatttcccacagaagctgcagcaggttttgcagaggctcccagcaaggagtatctcctcagtagcctacaccatctccccgggacccagacaaccttagagtcacatggatggtcagacagaccttgacatgagggcagcttgctggcagcttgactttctaaacagaattggaggcaaatttaaatgtcacaaaggtgtttctcattgatttgactttattagaacctgagtgatttcagacacacaaaggccagtaagaacagaattgctttcacctctggaaatcgttttcagatgtgccgctttcttctatccaggacgtttgctggaagaatgtaactcaatagtgtaccctcaacgtggctgccagttagggtgctgggatcagagagaggctttttcagggagaccatcagtgggtgggagaagatgtctcatctccacccgagtctccattgtgagctttctgagcatttcaccatggagactcggcacagacgtgttccttggctttcctgtaggaatccagggcccaccagagcttcccttagcaccagcagtggcagctggttcattttgccaccctccagtagccttttcctggtggttctgcattgtacctgagaaagagccaggactcagttgcttttgcaaagcagaaccctgttcccttgcagcacctgcctgggcccccagggagccaaaagactgctctgctgagttctctcttttctggaagttgctcactcgagaagaatgaaatctgcccgccatggtggcttatgcctataatcccagcactttgggaggctaaggcgggaggatcgcttgagctcaggagttggagaccagcctgggcaacatagtgagacctcgtctctcaaaaaattaata

SEQ ID NO: 349 - DNA, 486 bp, Artificial
  Synthetic oligonucleotide
gagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaaaaaaaaaagattgagagcttattctcatacttttgggtggtggggtccttgggtatatgacatgaggacttagttggaaatgctgttgatgccagcatatttctccaggcctttcttggtccttcttgccccttgctcctaacagaactgagaactgcctggaaaggccagcttccttttttcttctccagcagtgagcaccagctgtctgcataggagccctgttg

SEQ ID NO: 350 - DNA, 96 bp, Artificial
  Synthetic oligonucleotide
aaagcatgtacctacatcagatctaaccttgatcccagcaatgtggattccctcttctacgctgcccaggccagccaggccctctcaggatgtgag

SEQ ID NO: 351 - DNA, 43 bp, Artificial
  Synthetic oligonucleotide
gtgcccttactgctcgtctcagcaaggaggagactgtgctggc

SEQ ID NO: 352 - DNA, 76 bp, Artificial
  Synthetic oligonucleotide
aacagtccaggctctgcagacagcatcccacctgtcccagcaggctgacctgaggagcatcgtggaggagattgag

SEQ ID NO: 353 - DNA, 105 bp, Artificial
  Synthetic oligonucleotide
gaccttgttgctcgcctggatgaactcgggggcgtgtatctccagtttgaagaaggactggaaacaacagcgttatttgtggctgccacctacaagctcatggat

SEQ ID NO: 354 - DNA, 30 bp, Artificial
  Synthetic oligonucleotide
catgtggggactgagccatccattaaggag

SEQ ID NO: 355 - DNA, 11 bp, Artificial
  Synthetic oligonucleotide
ctatcttgcgg

SEQ ID NO: 356 - DNA, 119 bp, Artificial
  Synthetic oligonucleotide
ttgcaagtcaccaatgttctgtctcagcctctgactcaggccactgttaaactagaacatgctaaatctgttgcttccagagccactgtcctccagaagacatccttcacccctgtagg

SEQ ID NO: 357 - DNA, 28 bp, Artificial
  Synthetic oligonucleotide
ggatgtttttgaactaaatttcatgaac

SEQ ID NO: 358 - DNA, 78 bp, Artificial
  Synthetic oligonucleotide
gtcaaattttccagtggttattatgacttccttgtcgaagttgaaggtgacaaccggtatattgcaaataccgtagag

SEQ ID NO: 359 - DNA, 5 bp, Artificial
  Synthetic oligonucleotide
ctcag

SEQ ID NO: 360 - DNA, 23 bp, Artificial
  Synthetic oligonucleotide
agtcaagatctccactgaagttg

SEQ ID NO: 361 - DNA, 64 bp, Artificial
  Synthetic oligonucleotide
gcatcacaaatgttgatctttccaccgtggataaggatcagagcattgcacccaaaactacccg

SEQ ID NO: 362 - DNA, 63 bp, Artificial
  Synthetic oligonucleotide
ggtgacatacccagccaaagccaagggcacattcatcgcagacagccaccagaacttcgcctt

SEQ ID NO: 363 - DNA, 52 bp, Artificial
  Synthetic oligonucleotide
gttcttccagctggtagatgtgaacactggtgctgaactcactcctcaccag

SEQ ID NO: 364 - DNA, 101 bp, Artificial
  Synthetic oligonucleotide
acatttgtccgactccataaccagaagactggccaggaagtggtgtttgttgccgagccagacaacaagaacgtgtacaagtttgaactggatacctctga

SEQ ID NO: 365 - DNA, 42 bp, Artificial
  Synthetic oligonucleotide
aagaaagattgaatttgactctgcctctggcacctacactct

SEQ ID NO: 366 - DNA, 52 bp, Artificial
  Synthetic oligonucleotide
ctacttaatcattggagatgccactttgaagaacccaatcctctggaatgtg

SEQ ID NO: 367 - DNA, 28 bp, Artificial
  Synthetic oligonucleotide
gtatgtgcctgaatgtaccccgacccag

SEQ ID NO: 368 - DNA, 59 bp, Artificial
  Synthetic oligonucleotide
ctaatggatcagaagtgattgggactgcctggagctttttttcagttatggtcttagat

SEQ ID NO: 369 - DNA, 80 bp, Artificial
  Synthetic oligonucleotide
gtgagtcagagaatattatctattgagtttcacccacttctctgcccctgtgcttttacagactgtccttatttttctag

SEQ ID NO: 370 - DNA, 67 bp, Artificial
  Synthetic oligonucleotide
gctgatgtggtcatcaagttccctgaggaagaagctccctcgactgtcttgtcccagaaccttttca

SEQ ID NO: 371 - DNA, 20 bp, Artificial
  Synthetic oligonucleotide
ctccaaaacaggaaattcag

SEQ ID NO: 372 - DNA, 35 bp, Artificial
  Synthetic oligonucleotide
cacctgttccgcgagcctgagaagaggccccccac

SEQ ID NO: 373 - DNA, 61 bp, Artificial
  Synthetic oligonucleotide
cgtggtgtccaatacattcactgccctgatcctctcgccgttgcttctgctcttcgctctg

SEQ ID NO: 374 - DNA, 35 bp, Artificial
  Synthetic oligonucleotide
tggatccggattggtgccaatgtctccaacttcac

SEQ ID NO: 375 - DNA, 41 bp, Artificial
  Synthetic oligonucleotide
ttttgctcctagcacgattatatttcacctgggacatgctg

SEQ ID NO: 376 - DNA, 75 bp, Artificial
  Synthetic oligonucleotide
ctatgctgggactcatgtatgtctactggactcagctcaacatgttccagaccttgaagtacctggccatcttgg

SEQ ID NO: 377 - DNA, 22 bp, Artificial
  Synthetic oligonucleotide
gcagtgtgacgtttctggctgg

SEQ ID NO: 378 - DNA, 22 bp, Artificial
  Synthetic oligonucleotide
caatcggatgctggcccagcag

SEQ ID NO: 379 - DNA, 7 bp, Artificial
  Synthetic oligonucleotide
gcagtca

SEQ ID NO: 380 - DNA, 4 bp, Artificial
  Synthetic oligonucleotide
agag

SEQ ID NO: 381 - DNA, 5 bp, Artificial
  Synthetic oligonucleotide
aacag

SEQ ID NO: 382 - DNA, 14 bp, Artificial
  Synthetic oligonucleotide
cacattagttccag

SEQ ID NO: 383 - DNA, 40 bp, Artificial
  Synthetic oligonucleotide
aagaaagatggaaattctgaaaactgaatgtcaagaaaag

SEQ ID NO: 384 - protein, 631 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAAMLGLMYVYWTQLNMFQTLKYLAILGSVTFLAGNRMLAQQAVKRTAH

SEQ ID NO: 385 - protein, 501 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVVCA

SEQ ID NO: 386 - protein, 444 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQICHIWKLIFLP

SEQ ID NO: 387 - protein, 503 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVLMDQK

SEQ ID NO: 388 - protein, 628 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAAMLGLMYVYWTQLNMFQTLKYLAILGSVTFLAGNRMLAQQAVKR

SEQ ID NO: 389 - protein, 343 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNSQDLH

SEQ ID NO: 390 - protein, 563 aa, Homo sapiens [sequence omitted]

SEQ ID NO: 391 - protein, 459 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFAFGSGLVPMSPTSLLLLARLYFTWDMLLCWDSCMSTGLSSTCSRP

SEQ ID NO: 392 - protein, 397 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVEGQVRWLTPVIPALWEAKAGGSPEVRSSILAWPT

SEQ ID NO: 393 - protein, 329 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVG

SEQ ID NO: 394 - protein, 334 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAIGCWPSRQSREQHISSRRKMEILKTECQEKESRTIHSMRRKMEKKNFI

SEQ ID NO: 395 - protein, 160 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALMDPDWCQCLQLHFCS

SEQ ID NO: 396 - protein, 160 aa, Homo sapiens [sequence omitted]

SEQ ID NO: 397 - protein, 116 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCENSPGSADSIPPVPAG

SEQ ID NO: 398 - protein, 84 aa, Homo sapiens
MAPPGSSTVFLLALTIIASTWALTPTHYLTKHDVERLKASLDRPFTNLESAFYSIVGLSSLGAQVPDAKNSPGSADSIPPVPAG

SEQ ID NO: 399 - DNA, 2816 bp, Homo sapiens
tcacagtttgctcatctataaagtgagcgaaagtaatgtaatctttattgggagtagggaacatgaaggcgagtcgatacagtaagtaagccgccaagcatattgctaggcacagagcaggtgtgcaacaaaagttatttctcaggctttccctcctctgagcgccgtcctccagagggtccggagtgtagctgggggttggagcagcagcctcctaggcgatgggacagagcccacagggtccggtatgccacggtttcttcgtcagaccctgggaatccaacgtcgcaaaataaacacggccgcgccgctaatcgccagttcggaggaaacaaaacagcgctgcgctgggggatctgggcaaaatcagccctccctcctcccgctccttcgccgcggccctcccctcctcgcgctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccgtaagtcctggagctcctcaaggcccatcacttctatgttcctgagtccagggagccccgaaccagccagtgctaatactgctagatcctagaataacatggtttgctggggaagagtttggggtttggctttcagtgtttgcagttacttaaacactgcagtcagtttcattaataaagtgagaatcccac

SEQ ID NO: 400 - DNA, 2461 bp, Homo sapiens
tcacagtttgctcatctataaagtgagcgaaagtaatgtaatctttattgggagtagggaacatgaaggcgagtcgatacagtaagtaagccgccaagcatattgctaggcacagagcaggtgtgcaacaaaagttatttctcaggctttccctcctctgagcgccgtcctccagagggtccggagtgtagctgggggttggagcagcagcctcctaggcgatgggacagagcccacagggtccggtatgccacggtttcttcgtcagaccctgggaatccaacgtcgcaaaataaacacggccgcgccgctaatcgccagttcggaggaaacaaaacagcgctgcgctgggggatctgggcaaaatcagccctccctcctcccgctccttcgccgcggccctcccctcctcgcgctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgtaagtaacacaagtcccttgcctggcctgtcttatcctagccccttctcaaagccacctacctaatggccaccacataccagttatgctgttgaagttagcactacttctcagttaacaagcaggcaagatgctttctatgtgcagagcatcacacctgccccatcttctcaaggatgcaggctcaggctctgttttcccccaatggctttaataccacagccagatgtgatggctttaataccaactcagatgggatgattaactgttctgtgttcactcatgctctcagccacaacagaccaaacatgccctcaccctcagagcacacaggtgtactcatgcttagccagtctgatgtgtggaaagccagatttaccctgggttccattctcagtcccgtttcttttctgtctcctctatcccagagagattttatctgcccttgagtcaggtgaccaagggtatgctgacagtccccaaaaaaacctcctgccaaatggatggatacagtggtatatccgtcaggtttttggacagctctccatggatggtccacctggaccttaaactcatcatgtccaaaatgggtcccatcaccttcaaacaaacctgctgttctccatgtggagaaatattgaaagtacagtgagtgtcaaaaccctgtggattctgccttctgggcagctcacaaatcagtccttacttgattctcctccccttccttcaagccatcaccctttctcacctggaccacgtcacctttttcctttgctgtagtctccctcagtccaattcctcatccacagttactagagtgatcttttaagaatccaaataccggccaggcgcagtggcttacgctgtaatctcagcattttaggaagccaaggcgggcagatcacgaggtcaggagatcgagaccatgctggccaacatggtg

SEQ ID NO: 401 - DNA, 1593 bp, Homo sapiens
tcacagtttgctcatctataaagtgagcgaaagtaatgtaatctttattgggagtagggaacatgaaggcgagtcgatacagtaagtaagccgccaagcatattgctaggcacagagcaggtgtgcaacaaaagttatttctcaggctttccctcctctgagcgccgtcctccagagggtccggagtgtagctgggggttggagcagcagcctcctaggcgatgggacagagcccacagggtccggtatgccacggtttcttcgtcagaccctgggaatccaacgtcgcaaaataaacacggccgcgccgctaatcgccagttcggaggaaacaaaacagcgctgcgctgggggatctgggcaaaatcagccctccctcctcccgctccttcgccgcggccctcccctcctcgcgctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacaggtaagacaaaaaaatcacagaatgaccaaataacagaaatgcagtcaaagcactccttagatatctttcccaggggcttgaaatttgcagtacaatgtggtggaagaaaatctatttgctgagtttgggggttttatgtt

SEQ ID NO: 402 - DNA, 866 bp, Artificial
  Synthetic oligonucleotide
tcacagtttgctcatctataaagtgagcgaaagtaatgtaatctttattgggagtagggaacatgaaggcgagtcgatacagtaagtaagccgccaagcatattgctaggcacagagcaggtgtgcaacaaaagttatttctcaggctttccctcctctgagcgccgtcctccagagggtccggagtgtagctgggggttggagcagcagcctcctaggcgatgggacagagcccacagggtccggtatgccacggtttcttcgtcagaccctgggaatccaacgtcgcaaaataaacacggccgcgccgctaatcgccagttcggaggaaacaaaacagcgctgcgctgggggatctgggcaaaatcagccctccctcctcccgctccttcgccgcggccctcccctcctcgcgctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcg

SEQ ID NO: 403 - DNA, 149 bp, Artificial
  Synthetic oligonucleotide
gtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacag

SEQ ID NO: 404 - DNA, 140 bp, Artificial
  Synthetic oligonucleotide
gtaagacaaaaaaatcacagaatgaccaaataacagaaatgcagtcaaagcactccttagatatctttcccaggggcttgaaatttgcagtacaatgtggtggaagaaaatctatttgctgagtttgggggttttatgtt

SEQ ID NO: 405 - DNA, 943 bp, Artificial
  Synthetic oligonucleotide
gtaagtaacacaagtcccttgcctggcctgtcttatcctagccccttctcaaagccacctacctaatggccaccacataccagttatgctgttgaagttagcactacttctcagttaacaagcaggcaagatgctttctatgtgcagagcatcacacctgccccatcttctcaaggatgcaggctcaggctctgttttcccccaatggctttaataccacagccagatgtgatggctttaataccaactcagatgggatgattaactgttctgtgttcactcatgctctcagccacaacagaccaaacatgccctcaccctcagagcacacaggtgtactcatgcttagccagtctgatgtgtggaaagccagatttaccctgggttccattctcagtcccgtttcttttctgtctcctctatcccagagagattttatctgcccttgagtcaggtgaccaagggtatgctgacagtccccaaaaaaacctcctgccaaatggatggatacagtggtatatccgtcaggtttttggacagctctccatggatggtccacctggaccttaaactcatcatgtccaaaatgggtcccatcaccttcaaacaaacctgctgttctccatgtggagaaatattgaaagtacagtgagtgtcaaaaccctgtggattctgccttctgggcagctcacaaatcagtccttacttgattctcctccccttccttcaagccatcaccctttctcacctggaccacgtcacctttttcctttgctgtagtctccctcagtccaattcctcatccacagttactagagtgatcttttaagaatccaaataccggccaggcgcagtggcttacgctgtaatctcagcattttaggaagccaaggcgggcagatcacgaggtcaggagatcgagaccatgctggccaacatggtg

SEQ ID NO: 406 - DNA, 202 bp, Artificial
  Synthetic oligonucleotide
gagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgag

SEQ ID NO: 407 - DNA, 141 bp, Artificial
  Synthetic oligonucleotide
tcacccaacaaacccaccattccccaggagaaaatccggcccctgaccagcctggaccatcctcagagtcctttctatgacccagagggtgggtccatcactcaagtagccagagttgtcatcgagagaatcgcacggaag

SEQ ID NO: 408 - DNA, 183 bp, Artificial
  Synthetic oligonucleotide
atgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaag

SEQ ID NO: 409 - DNA, 158 bp, Artificial
  Synthetic oligonucleotide
acggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtc

SEQ ID NO: 410 - DNA, 165 bp, Artificial
  Synthetic oligonucleotide
acaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgcc

SEQ ID NO: 411 - DNA, 192 bp, Artificial
  Synthetic oligonucleotide
gtaagtcctggagctcctcaaggcccatcacttctatgttcctgagtccagggagccccgaaccagccagtgctaatactgctagatcctagaataacatggtttgctggggaagagtttggggtttggctttcagtgtttgcagttacttaaacactgcagtcagtttcattaataaagtgagaatcccac

SEQ ID NO: 412 - DNA, 107 bp, Artificial
  Synthetic oligonucleotide
taacactttcagctgctcctccctcctacttcagaggattcacattaattgccctcagagagaacagagagggtgataaggaagaagaccatgctgggaccttccag

SEQ ID NO: 413 - DNA, 52 bp, Artificial
  Synthetic oligonucleotide
atcatagacgaagaagaaactcagtttatgagcaattgccctgttgcagtca

SEQ ID NO: 414 - DNA, 82 bp, Artificial
  Synthetic oligonucleotide
ctgaaagcactccacggaggaggacccggatccaggtgttttggatagcaccaccagcgggaacaggctgcgtgattctgaa

SEQ ID NO: 415 - DNA, 74 bp, Artificial
  Synthetic oligonucleotide
ggccagcatcgtacaaaaacgcattatttattttcaagatgagggctctctgaccaagaaactttgtgaacaag

SEQ ID NO: 416 - DNA, 107 bp, Artificial
  Synthetic oligonucleotide
attccacatttgatggggtgactgacaaacccatcttagactgctgtgcctgcggaactgccaagtacagactcacattttatgggaattggtccgagaagacacac

SEQ ID NO: 417 - DNA, 16 bp, Artificial
  Synthetic oligonucleotide
ccaaaggattaccctc

SEQ ID NO: 418 - DNA, 65 bp, Artificial
  Synthetic oligonucleotide
agtgatgaggtcctcaccgtcatcaaagccaaagcccaatggccagcctggcagcctctcaacgt

SEQ ID NO: 419 - DNA, 76 bp, Artificial
  Synthetic oligonucleotide
ggtgaacaatgcaatattgtacctgacaatgtcgatgatattgtagctgacctggctccagaagagaaagatgaag

SEQ ID NO: 420 - DNA, 13 bp, Artificial
  Synthetic oligonucleotide
aacgaggagtgct

SEQ ID NO: 421 - DNA, 55 bp, Artificial
  Synthetic oligonucleotide
ctcccagcagctgcctgatgaccgagtggggcgagtgggacgagtgcagcgccac

SEQ ID NO: 422 - DNA, 113 bp, Artificial
  Synthetic oligonucleotide
ctgcggcatgggcatgaagaagcggcaccgcatgatcaagatgaaccccgcagatggctccatgtgcaaagccgagacatcacaggcagagaagtgcatgatgccagagtgcc

SEQ ID NO: 423 - protein, 807 aa, Homo sapiens
MRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCACGTAKYRLTFYGNWSEKTHPKDYPRRANHWSAIIGGSHSKNYVLWEYGGYASEGVKQVAELGSPVKMEEEIRQQSDEVLTVIKAKAQWPAWQPLNVRAAPSAEFSVDRTRHLMSFLTMMGPSPDWNVGLSAEDLCTKECGWVQKVVQDLIPWDAGTDSGVTYESPNKPTIPQEKIRPLTSLDHPQSPFYDPEGGSITQVARVVIERIARKGEQCNIVPDNVDDIVADLAPEEKDEDDTPETCIYSNWSPWSACSSSTCDKGKRMRQRMLKAQLDLSVPCPDTQDFQPCMGPGCSDEDGPTCTMSEWITWSPCSISCGMGMRSRERYVKQFPEDGSVCTLPTEETEKCTVNEECSPSSCLMTEWGEWDEYSATCGMGMKKRHRMIKMNPADGSMCKAETSQAEKRMMPECHTIPCLLSPWSEWSDCSVTCGKGMRTRQRMLKSLAELGDCNEDLEQVEKCMLPECPIDCELTEWSQWSECNKSCGKGHVIRTRMIQMEPQFGGAPCPETVQRKKCRIRKCLRNPSIQKLRWREARESRRSEQLKEESEGEQFPGCRMRPWTAWSECTKLCGGGIQERYMTVKKRFKSSQFTSCKDKKEIRACNVHPC

SEQ ID NO: 424 - protein, 807 aa, Homo sapiens [sequence omitted]

SEQ ID NO: 425 - protein, 724 aa, Homo sapiens
AAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCACGTAKYRLTFYGNWSEKTHPKDYPRRANHWSAIIGGSHSKNYVLWEYGGYASEGVKQVAELGSPVKMEEEIRQQSDEVLTVIKAKAQWPAWQPLNVRAAPSAEFSVDRTRHLMSFLTMMGPSPDWNVGLSAEDLCTKECGWVQKVVQDLIPWDAGTDSGVTYESPNKPTIPQEKIRPLTSLDHPQSPFYDPEGGSITQVARVVIERIARKGEQCNIVPDNVDDIVADLAPEEKDEDDTPETCIYSNWSPWSACSSSTCDKGKRMRQRMLKAQLDLSVPCPDTQDFQPCMGPGCSDEDGSTCTMSEWITWSPCSISCGMGMRSRERYVKQFPEDGSVCTLPTEETEKCTVNEECSPSSCLMTEWGEWDECSATCGMGMKKRHRMIKMNPADGSMCKAETSQAEKCMMPECHTIPCLLSPWSEWSDCSVTCGKGMRTRQRMLKSLAELGDCNEDLEQVEKCMLPECPIDCELTEWSQWSECNKSCGKGHVIRTRMIQMEPQFGGAPCPETVQRKKCRIRKCLRNPSIQKLRWREARESRRSEQLKEESEGEQFPGCRMRPWTAWSECTKLCGGGIQERYMTVKKRFKSSQFTSCKDKKEIRACNVHPC

SEQ ID NO: 426 - protein, 695 aa, Homo sapiens
MRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCACGTAKYRLTFYGNWSEKTHPKDYPRRANHWSAIIGGSHSKNYVLWEYGGYASEGVKQVAELGSPVKMEEEIRQQSDEVLTVIKAKAQWPAWQPLNVRAAPSAEFSVDRTRHLMSFLTMMGPSPDWNVGLSAEDLCTKECGWVQKVVQDLIPWDAGTDSGVTYESPNKPTIPQEKIRPLTSLDHPQSPFYDPEGGSITQVARVVIERIARKGEQCNIVPDNVDDIVADLAPEEKDEDDTPETCIYSNWSPWSACSSSTCDKGKRMRQRMLKAQLDLSVPCPDTQDFQPCMGPGCSDEDGSTCTMSEWITWSPCSISCGMGMRSRERYVKQFPEDGSVCTLPTEETEKCTVNEECSPSSCLMTEWGEWDECSATCGMGMKKRHRMIKMNPADGSMCKAETSQAEKCMMPECHTIPCLLSPWSEWSDCSVTCGKGMRTRQRMLKSLAELGDCNEDLEQVEKCMLPECRKSWSSSRPITSMFLSPGSPEPASANTARS

SEQ ID NO: 427 - protein, 297 aa, Homo sapiens
MRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCACGTAKYRLTFYGNWSEKTHPKDYPRRANHWSAIIGGSHSKNYVLWEYGGYASEGVKQVAELGSPVKMEEEIRQQSDEVLTVIKAKAQWPAWQPLNV

SEQ ID NO: 428 - protein, 285 aa, Homo sapiens
MRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCACGTAKYRLTFYGNWSEKTHPKDYPRRANHWSAIIGGSHSKNYVLWEYGGYASEGVKQVAELGSPVKMEEEIRQQVRQKNHRMTK

SEQ ID NO: 429 - DNA, 2113 bp, Homo sapiens
tgctacgcctgcgcagtaggcctccgggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccgatgacaagacaaatggctagctctggtgcatcagggggcaaaatcgataattctgtgttagtccttattgtgggcttatcaacagtaggagctggtgcctatgcctacaagactatgaaagaggacgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaaaa

SEQ ID NO: 430 - DNA, 226 bp, Artificial
  Synthetic oligonucleotide
tgctacgcctgcgcagtaggcctccgggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccg

SEQ ID NO: 431 - DNA, 125 bp, Artificial
  Synthetic oligonucleotide
cttcagaaggagaggaagttcctcaagacaaggcgccaagtcatgttcctttcctgctaattggtggaggcacagctgcttttgctgcagccagatccatccgggctcgggatcctggggccagg

SEQ ID NO: 432 - DNA, 131 bp, Artificial
  Synthetic oligonucleotide
gtactgattgtatctgaagatcctgagctgccgtacatgcgacctcctctttcaaaagaactgtggttttcagatgacccaaatgtcacaaagacactgcgattcaaacagtggaatggaaaagagagaag

SEQ ID NO: 433 - DNA, 143 bp, Artificial
  Synthetic oligonucleotide
gcaggagatgctgcatgcttctacgatataaagttgggaaggaggcgggtagagcaccatgatcacgctgttgtgagtggaagattggctggagaaaatatgactggagctgctaagccgtactggcatcagtcaatgttctg

SEQ ID NO: 434 - DNA, 125 bp, Artificial
  Synthetic oligonucleotide
gagtgatttgggccccgatgttggctatgaagctattggtcttgtggacagtagtttgcccacagttggtgtttttgcaaaagcaactgcacaagacaaccccaaatctgccacagagcagtcag

SEQ ID NO: 435 - DNA, 133 bp, Artificial
  Synthetic oligonucleotide
caccccggcagttccacaggctcccgtccagggggaggactacggcaaaggtgtcatcttctacctcagggacaaagtggtcgtggggattgtgctatggaacatctttaaccgaatgccaatagcaaggaag

SEQ ID NO: 436 - DNA, 611 bp, Artificial
  Synthetic oligonucleotide
atcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaaaaaaaaaaagttctcttgtcaagggggcaggtgggtgaaggtggaaagccacgcatattagaaagcaagcaaattgcagcaccgaccaagcacaggatttttctcagccatgtattcatgccctactccagacgcaaaactcctttcatttccgaacttccctcacccctccagacctctttgcacacacctgctgtggcctcggcccacaacacttgactcccctcctctcctctcaggaagttcactatctctgaagactttcccagccttccaagcctcatccttgtgtatgtgtctccctgctagcccatgacttcctggaagcagaagccctgatgtgtcctaa

SEQ ID NO: 437 - DNA, 102 bp, Artificial
  Synthetic oligonucleotide
atgacaagacaaatggctagctctggtgcatcagggggcaaaatcgataattctgtgttagtccttattgtgggcttatcaacagtaggagctggtgcctat

SEQ ID NO: 438 - DNA, 100 bp, Artificial
  Synthetic oligonucleotide
gcctacaagactatgaaagaggacgaaaaaagatacaatgaaagaatttcagggttagggctgacaccagaacagaaacagaaaaaggccgcgttatctg

SEQ ID NO: 439 - DNA, 91 bp, Artificial
  Synthetic oligonucleotide
catatatttccagccaccttctttctatgtctctgctcaggacctgcctcatattgagaatggtggtgtggctgtcctcactgggaagaag

SEQ ID NO: 440 - DNA, 85 bp, Artificial
  Synthetic oligonucleotide
gtagtacagctggatgtgagagacaacatggtgaaacttaatgatggctctcaaataacctatgaaaagtgcttgattgcaacag

SEQ ID NO: 441 - DNA, 77 bp, Artificial
  Synthetic oligonucleotide
gaggtactccaagaagtctgtctgccattgatagggctggagcagaggtgaagagtagaacaacgcttttcagaaag

SEQ ID NO: 442 - DNA, 109 bp, Artificial
  Synthetic oligonucleotide
attggagactttagaagcttggagaagatttcacgggaagtcaaatcaattacgattatcggtgggggcttccttggtagcgaactggcctgtgctcttggcagaaagg

SEQ ID NO: 443 - DNA, 108 bp, Artificial
  Synthetic oligonucleotide
ctcgagccttgggcacagaagtgattcaactcttccccgagaaaggaaatatgggaaagatcctccccgaatacctcagcaactggaccatggaaaaagtcagacgag

SEQ ID NO: 444 - DNA, 89 bp, Artificial
  Synthetic oligonucleotide
agggggttaaggtgatgcccaatgctattgtgcaatccgttggagtcagcagtggcaagttacttatcaagctgaaagacggcaggaag

SEQ ID NO: 445 - DNA, 61 bp, Artificial
  Synthetic oligonucleotide
gtagaaactgaccacatagtggcagctgtgggcctggagcccaatgttgagttggccaaga

SEQ ID NO: 446 - DNA, 24 bp, Artificial
  Synthetic oligonucleotide
ctggtggcctggaaatagactcag

SEQ ID NO: 447 - DNA, 56 bp, Artificial
  Synthetic oligonucleotide
attttggtggcttccgggtaaatgcagagctacaagcacgctctaacatctgggtg

SEQ ID NO: 448 - DNA, 64 bp, Artificial
  Synthetic oligonucleotide
gaactggtatccgatcagagagtgagacagagtccgaggcctcagaaattactattcctcccag

SEQ ID NO: 449 - protein, 613 aa, Homo sapiens
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 450 - protein, 564 aa, Homo sapiens [sequence omitted]

SEQ ID NO: 451 - DNA, 1749 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctgctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacgatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 452 - DNA, 1436 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatgtttttgcagatttataaacaagggggttttctgggcctctccaatattaagttcagtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 453 - DNA, 1455 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcagtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 454 - DNA, 1407 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 455 - DNA, 1380 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 456 - DNA, 1330 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgcttgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 457 - DNA, 1423 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 458 - DNA, 1325 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgcttctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 459 - DNA, 1404 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatgtttttgcagatttataaacaagggggttttctgggcctctccaatattaagttcagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 460 - DNA, 1298 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgcttctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 461 - DNA, 1304 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 462 - DNA, 1314 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatgtttttgcagatttataaacaagggggttttctgggcctctccaatattaagttcaggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 463 - DNA, 1235 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 464 - DNA, 1582 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtagaagaagaagtgtcagcagaccaggtgagcgtgggtgccagtggggttcttgggagcttcaaggaagcaaggaacgctccctccttcctctcctggtctttctctatgggacctagtaaataattactgcagccacctgaggctggaaaaccactccaggtgggggaggagagagtttagttttcttgctcctattttcctcctcctggagacctccctctctcggctttacaaagacacagatacaccccgccccccaaaacacacacacacacacacacacacacacctccttaggctggaacagcagagaatggagggacaagggggctgattagagccaagaagagggagtgaaggagagcagagggaggagggcagccctgtttacagtcacctggctggtggggtggcaggtgctctctctgaattaaccctttgagagctggccaggactctggactgattaccccagcctggggtggcatccaggggctctaggaggtaccttttgctcctcaccctggatctcttttccttccacccaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 465 - DNA, 564 bp, Artificial
  Synthetic oligonucleotide
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacag

SEQ ID NO: 466 - DNA, 176 bp, Artificial
  Synthetic oligonucleotide
gctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacg

SEQ ID NO: 467 - DNA, 132 bp, Artificial
  Synthetic oligonucleotide
gatctgtggtggtacaattgactctggccttccgagaaggtaccatcaatgtccacgacgtggagacacagttcaatcagtataaaacggaagcagcctctcgatataacctgacgatctcagacgtcagcg

SEQ ID NO: 468 - DNA, 140 bp, Artificial
  Synthetic oligonucleotide
gctgtctgtcagtgccgccgaaagaactacgggcagctggacatctttccagcccgggatacctaccatcctatgagcgagtaccccacctaccacacccatgggcgctatgtgccccctagcagtaccgatcgtagccc

SEQ ID NO: 469 - DNA, 524 bp, Artificial
  Synthetic oligonucleotide
gtgagcgtgggtgccagtggggttcttgggagcttcaaggaagcaaggaacgctccctccttcctctcctggtctttctctatgggacctagtaaataattactgcagccacctgaggctggaaaaccactccaggtgggggaggagagagtttagttttcttgctcctattttcctcctcctggagacctccctctctcggctttacaaagacacagatacaccccgccccccaaaacacacacacacacacacacacacacacctccttaggctggaacagcagagaatggagggacaagggggctgattagagccaagaagagggagtgaaggagagcagagggaggagggcagccctgtttacagtcacctggctggtggggtggcaggtgctctctctgaattaaccctttgagagctggccaggactctggactgattaccccagcctggggtggcatccaggggctctaggaggtaccttttgctcctcaccctggatctcttttccttccacccag

SEQ ID NO: 470 - DNA, 262 bp, Artificial
  Synthetic oligonucleotide
ttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 471 - DNA, 27 bp, Artificial
  Synthetic oligonucleotide
ctaccacagcccctaaacccgcaacag

SEQ ID NO: 472 - DNA, 9 bp, Artificial
  Synthetic oligonucleotide
ttgttacag

SEQ ID NO: 473 - DNA, 27 bp, Artificial
  Synthetic oligonucleotide
gttctggtcatgcaagctctaccccag

SEQ ID NO: 474 - DNA, 38 bp, Artificial
  Synthetic oligonucleotide
gtggagaaaaggagacttcggctacccagagaagttca

SEQ ID NO: 475 - DNA, 27 bp, Artificial
  Synthetic oligonucleotide
gtgcccagctctactgagaagaatgct

SEQ ID NO: 476 - DNA, 19 bp, Artificial
  Synthetic oligonucleotide
tttaattcctctctggaag

SEQ ID NO: 477 - DNA, 50 bp, Artificial
  Synthetic oligonucleotide
atcccagcaccgactactaccaagagctgcagagagacatttctgaaatg

SEQ ID NO: 478 - DNA, 9 bp, Artificial
  Synthetic oligonucleotide
tttttgcag

SEQ ID NO: 479 - DNA, 47 bp, Artificial
  Synthetic oligonucleotide
atttataaacaagggggttttctgggcctctccaatattaagttcag

SEQ ID NO: 480 - DNA, 5 bp, Artificial
  Synthetic oligonucleotide
gccag

SEQ ID NO: 481 - DNA, 32 bp, Artificial
  Synthetic oligonucleotide
tgagtgatgtgccatttcctttctctgcccag

SEQ ID NO: 482 - DNA, 90 bp, Artificial
  Synthetic oligonucleotide
tctggggctggggtgccaggctggggcatcgcgctgctggtgctggtctgtgttctggttgcgctggccattgtctatctcattgccttg

SEQ ID NO: 483 - DNA, 10 bp, Artificial
  Synthetic oligonucleotide
ctatgagaag

SEQ ID NO: 484 - DNA, 27 bp, Artificial
  Synthetic oligonucleotide
gtagaagaagaagtgtcagcagaccag

SEQ ID NO: 485 - DNA, 32 bp, Artificial
  Synthetic oligonucleotide
gtttctgcaggtaatggtggcagcagcctctc

SEQ ID NO: 486 - DNA, 99 bp, Artificial
  Synthetic oligonucleotide
ttacacaaacccagcagtggcagccacttctgccaacttgtaggggcacgtcgcccgctgagctgagtggccagccagtgccattccactccactcagg

SEQ ID NO: 487 - protein, 1255 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 488 - protein, 203 aa, Homo sapiens
MTPGTQSPFFLLLLLTVLTVVTGSGHASSTPGGEKETSATQRSSVPSSTEKNAIPAPTTTKSCRETFLKCFCRFINKGVFWASPILSSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 489 - protein, 149 aa, Homo sapiens
MTPGTQSPFFLLLLLTVLTVVTGSGHASSTPGGEKETSATQRSSVPSSTEKNAFNSSLEDPSTDYYQELQRDISEMFLQIYKQGGFLGLSNIKFSLGLGCQAGASRCWCWSVFWLRWPLSISLPWLSVSAAERTTGSWTSFQPGIPTIL

SEQ ID NO: 490 - protein, 166 aa, Homo sapiens
MTPGTQSPFFLLLLLTVLTATTAPKPATVVTGSGHASSTPGGEKETSATQRSSVPSSTEKNASGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 491 - protein, 157 aa, Homo sapiens
MTPGTQSPFFLLLLLTVLTVVTGSGHASSTPGGEKETSATQRSSVPSSTEKNASGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 492 - protein, 159 aa, Homo sapiens
MTPGTQSPFFLLLLLTVLTATTAPKPATVVTGSGHASSTPGGEKETSATQRSSVPSSTEKNAFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 493 - protein, 136 aa, Homo sapiens
MTPGTQSPFFLLLLLTVLTATTAPKPATVVTGSGHASSTPGGEKETSATQRSSVPSSTEKNAAVCQCRRKNYGQLDIFPARDTYHPMSEYPTYHTHGRYVPPSSTDRSPYEKVSAGNGGSSLSYTNPAVAATSANL

SEQ ID NO: 494 - protein, 80 aa, Homo sapiens
MTPGTQSPFFLLLLLTVLTATTAPKPATVATGSGHASSTPGGEKETSATQRSSVPSSTEKNAIPAPTTTKSCRETFLKCE

SEQ ID NO: 495 - protein, 126 aa, Homo sapiens [sequence omitted]

SEQ ID NO: 496 - protein, 71 aa, Homo sapiens [sequence omitted]

SEQ ID NO: 497 - protein, 53 aa, Homo sapiens
MTPGTQSPFFLLLLLTVLTVVTGSGHASSTPGGEKETSATQRSSVPSSTEKNA

SEQ ID NO: 498 - protein, 128 aa, Homo sapiens [sequence omitted]

SEQ ID NO: 499 - protein, 158 aa, Homo sapiens [sequence omitted]

SEQ ID NO: 500 - protein, 96 aa, Homo sapiens [sequence omitted]

SEQ ID NO: 501 - protein, 85 aa, Homo sapiens
MTPGTQSPFFLLLLLTVLTVVTGSGHASSTPGGEKETSATQRSSVEEEVSADQVSVGASGVLGSFKEARNAPSFLSWSFSMGPSK

SEQ ID NO: 502 - DNA, 3897 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctgtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtcaa

SEQ ID NO: 503 - DNA, 3347 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacactttttccccaaatgagaggaggaagccccttggatgaggcaggagcagctcagactctgctccctgctctgcgcccggctcacccggtgactggctctgccctggctccacttggggtgggaccggggcatgtggagaaggtgtccaggtggcctgttttgaatctgggtaaatcaagctgccaatccacagcagagcctcccttgggtcaggttgcagggaaatgggaaaagagggagcctcgggacagactcctgagctgtgtcctggctctgaagtcactggctgtatgaggctgtggacacagcacataggacacagcagaggaaagtgagtgacacacacttggagaaatagggagattcagccataggggctctgcatgggagggaacaggcagtgccaaaaagtgtgtgtttatagagagggtaagactatcagccactatatatatctaacataaaacttaccattaaccatttctaagtgtacaattaagtgaaacagcataaatatcaatcaagtatattgcccggtgtggtggctcatccctgtaatcccagcactttgggaggccaaggcgagtggatcacctgaggtcaggagttcaagatacagaaaaaaaaaaatagctaggcatggtggtgggtgcctgtaatcccagctactcgggaggctgaggcaggagaatcgctcgaacctgggcggtgtagtttgcagtgagccgagattgagccactgcactccagcctgggtgacagagtgagactacatcacaaaaaaaaaaaaaaaaaagg

SEQ ID NO: 504 - DNA, 1886 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagctgtcaaaaggaacgatgcaggatcctatgaatgtgaaatacagaacccagcgagtgccaaccgcagtgacccagtcaccctgaatgtcctct

SEQ ID NO: 505 - DNA, 2429 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtcaa

SEQ ID NO: 506 - DNA, 2429 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtcaa

SEQ ID NO: 507 - DNA, 178 bp, Artificial
  Synthetic oligonucleotide
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacag

SEQ ID NO: 508 - DNA, 278 bp, Artificial
  Synthetic oligonucleotide
cctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccag

SEQ ID NO: 509 - DNA, 400 bp, Artificial
  Synthetic oligonucleotide
gtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccag

SEQ ID NO: 510 - DNA, 255 bp, Artificial
  Synthetic oligonucleotide
atggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatg

SEQ ID NO: 511 - DNA, 190 bp, Artificial
  Synthetic oligonucleotide
ctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctg

SEQ ID NO: 512 - DNA, 127 bp, Artificial
  Synthetic oligonucleotide
ctgtccaatggcaacaggaccctcactctattcaatgtcacaagaaatgacgcaagagcctatgtatgtggaatccagaactcagtgagtgcaaaccgcagtgacccagtcaccctggatgtcctct

SEQ ID NO: 513 - DNA, 255 bp, Artificial
  Synthetic oligonucleotide
atgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctg

SEQ ID NO: 514 - DNA, 1174 bp, Artificial
  Synthetic oligonucleotide
ctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacactttttccccaaatgagaggaggaagccccttggatgaggcaggagcagctcagactctgctccctgctctgcgcccggctcacccggtgactggctctgccctggctccacttggggtgggaccggggcatgtggagaaggtgtccaggtggcctgttttgaatctgggtaaatcaagctgccaatccacagcagagcctcccttgggtcaggttgcagggaaatgggaaaagagggagcctcgggacagactcctgagctgtgtcctggctctgaagtcactggctgtatgaggctgtggacacagcacataggacacagcagaggaaagtgagtgacacacacttggagaaatagggagattcagccataggggctctgcatgggagggaacaggcagtgccaaaaagtgtgtgtttatagagagggtaagactatcagccactatatatatctaacataaaacttaccattaaccatttctaagtgtacaattaagtgaaacagcataaatatcaatcaagtatattgcccggtgtggtggctcatccctgtaatcccagcactttgggaggccaaggcgagtggatcacctgaggtcaggagttcaagatacagaaaaaaaaaaatagctaggcatggtggtgggtgcctgtaatcccagctactcgggaggctgaggcaggagaatcgctcgaacctgggcggtgtagtttgcagtgagccgagattgagccactgcactccagcctgggtgacagagtgagactacatcacaaaaaaaaaaaaaaaaaagg

SEQ ID NO: 515 - DNA, 179 bp, Artificial
  Synthetic oligonucleotide
ctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgagg

SEQ ID NO: 516 - DNA, 732 bp, Artificial
  Synthetic oligonucleotide
tttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtcaa

SEQ ID NO: 517 - DNA, 280 bp, Artificial
  Synthetic oligonucleotide
cggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagctgtcaaaaggaacgatgcaggatcctatgaatgtgaaatacagaacccagcgagtgccaaccgcagtgacccagtcaccctgaatgtcctct

SEQ ID NO: 518 - DNA, 82 bp, Artificial
  Synthetic oligonucleotide
aatgacacaggattctacaccctacacgtcataaagtcagatcttgtgaatgaagaagcaactggccagttccgggtatacc

SEQ ID NO: 519 - DNA, 104 bp, Artificial
  Synthetic oligonucleotide
cggagctgcccaagccctccatctccagcaacaactccaaacccgtggaggacaaggatgctgtggccttcacctgtgaacctgagactcaggacgcaacctac

SEQ ID NO: 520 - DNA, 48 bp, Artificial
  Synthetic oligonucleotide
ctgtggtgggtaaacaatcagagcctcccggtcagtcccaggctgcag

SEQ ID NO: 521 - DNA, 48 bp, Artificial
  Synthetic oligonucleotide
ctgtccaatggcaacaggaccctcactctattcaatgtcacaagaaat

SEQ ID NO: 522 - DNA, 79 bp, Artificial
  Synthetic oligonucleotide
gacacagcaagctacaaatgtgaaacccagaacccagtgagtgccaggcgcagtgattcagtcatcctgaatgtcctct

SEQ ID NO: 523 - DNA, 3 bp, Artificial
  Synthetic oligonucleotide
cag

SEQ ID NO: 524 - DNA, 6 bp, Artificial
  Synthetic oligonucleotide
agccac

SEQ ID NO: 525 - DNA, 7 bp, Artificial
  Synthetic oligonucleotide
ccaaacc

SEQ ID NO: 526 - DNA, 18 bp, Artificial
  Synthetic oligonucleotide
cttcatcaccagcaacaa

SEQ ID NO: 527 - DNA, 70 bp, Artificial
  Synthetic oligonucleotide
ctccaaccccgtggaggatgaggatgctgtagccttaacctgtgaacctgagattcagaacacaacctac

SEQ ID NO: 528 - DNA, 24 bp, Artificial
  Synthetic oligonucleotide
ctgtggtgggtaaataatcagagc

SEQ ID NO: 529 - DNA, 24 bp, Artificial
  Synthetic oligonucleotide
ctcccggtcagtcccaggctgcag

SEQ ID NO: 530 - DNA, 78 bp, Artificial
  Synthetic oligonucleotide
ctgtccaatgacaacaggaccctcactctactcagtgtcacaaggaatgatgtaggaccctatgagtgtggaatccag

SEQ ID NO: 531 - DNA, 30 bp, Artificial
  Synthetic oligonucleotide
aacgaattaagtgttgaccacagcgaccca

SEQ ID NO: 532 - DNA, 19 bp, Artificial
  Synthetic oligonucleotide
gtcatcctgaatgtcctct

SEQ ID NO: 533 - DNA, 19 bp, Artificial
  Synthetic oligonucleotide
atggcccagacgaccccac

SEQ ID NO: 534 - DNA, 18 bp, Artificial
  Synthetic oligonucleotide
catttccccctcatacac

SEQ ID NO: 535 - DNA, 28 bp, Artificial
  Synthetic oligonucleotide
ctattaccgtccaggggtgaacctcagc

SEQ ID NO: 536 - DNA, 22 bp, Artificial
  Synthetic oligonucleotide
cggagctgcccaagccctccat

SEQ ID NO: 537 - DNA, 82 bp, Artificial
  Synthetic oligonucleotide
ctccagcaacaactccaaacccgtggaggacaaggatgctgtggccttcacctgtgaacctgaggctcagaacacaacctac

SEQ ID NO: 538 - DNA, 48 bp, Artificial
  Synthetic oligonucleotide
ctgtggtgggtaaatggtcagagcctcccagtcagtcccaggctgcag

SEQ ID NO: 539 - DNA, 33 bp, Artificial
  Synthetic oligonucleotide
gtaagtggctccctggagcatcagcatcatatt

SEQ ID NO: 540 - DNA, 27 bp, Artificial
  Synthetic oligonucleotide
catctggaacttctcctggtctctcag

SEQ ID NO: 541 - DNA, 92 bp, Artificial
  Synthetic oligonucleotide
ctggggccactgtcggcatcatgattggagtgctggttggggttgctctgatatagcagccctggtgtagtttcttcatttcaggaagactg

SEQ ID NO: 542 - DNA, 26 bp, Artificial
  Synthetic oligonucleotide
acagttgttttgcttcttccttaaag

SEQ ID NO: 543 - DNA, 101 bp, Artificial
  Synthetic oligonucleotide
catttgcaacagctacagtctaaaattgcttctttaccaaggatatttacagaaaagactctgaccagagatcgagaccatcctagccaacatcgtgaaac

SEQ ID NO: 544 - DNA, 34 bp, Artificial
  Synthetic oligonucleotide
cccatctctactaaaaatacaaaaatgagctggg

SEQ ID NO: 545 - DNA, 44 bp, Artificial
  Synthetic oligonucleotide
cttggtggcgcgcacctgtagtcccagttactcgggaggctgag

SEQ ID NO: 546 - DNA, 4 bp, Artificial
  Synthetic oligonucleotide
gcag

SEQ ID NO: 547 - DNA, 88 bp, Artificial
  Synthetic oligonucleotide
gagaatcgcttgaacccgggaggtggagattgcagtgagcccagatcgcaccactgcactccagtctggcaacagagcaagactccat

SEQ ID NO: 548 - DNA, 30 bp, Artificial
  Synthetic oligonucleotide
ataatattttcataattttttatttgaaat

SEQ ID NO: 549 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 550 - protein, 315 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLCEYICSSLAQAASPNPQGQRQDFSVPLRFKYTDPQPWTSRLSVTFCPRKTWADQVLTKNRRGGAASVLGGSGSTPYDGRNR

SEQ ID NO: 551 - protein, 719 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSGKWLPGASASYSGVESIWFSPKSQEDIFFPSLCSMGTRKSQILS

SEQ ID NO: 552 - protein, 569 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSNPVEDKDAVAFTCEPEVQNTTYLWWVNGQSLPVSPRLQLSNGNMTLTLLSCQKERCRIL

SEQ ID NO: 553 - protein, 346 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 554 - protein, 346 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 555 - DNA, 6164 bp, Homo sapiens
tacagtataaaacttcacagtgccaataccatgaagaggagctcagacagctcttaccacatgatacaagagccggctggtggaagagtggggaccagaaagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggcacagtgaaatcttgatgaagaatggaaaattaaaggaacagacgctttttacagggaggcttcccccagcccccatcccatggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaacaaaaaaaaaaaacaaaaaaaaacaaaagtaaattaaaaacaaaacctgatgaaacagatgaaggaagatgtggaaaaaatccttagccagggctcagagatgaagcagtgaaagagacaggaattgggagggaaagggagaatggtgtaccctttatttcttctgaaatcacactgatgacatcagttgtttaaacggggtattgtcctttccccccttgaggttcccttgtgagccttgaatcaaccaatctagtctgcagtagtgtggactagaacaacccaaatagcatctagaaagccatgagtttgaaagggcccatcacaggcactttcctacccaattacccaggtcataaggtatgtctgtgtgacacttatctctgtgtatatcagcatacacacacacacacacacacacacacacacacaggcatttccacacattacatatatacacatactggtaaaagaacaatcgtgtgcaggtggtcacacttcctttttctgtaccacttttgcaacaaaacaaaacaaacaacattaaaaaattgagaacaagtatggaaagaatgaaagatcaaggaaaaaagaataccaagttacatttcgttaaggtgcttatgatcttagaactatgcaacctaataggtttgaaactgtttacctgagagagaacaaaaagagagacttttttgtattggaagtaatctgattaatttttattttcttcaaggagagatacttgaaaggaatatgtttgtccatctgttggatccaaacatttctatattttgtaaatgttgttgttgttttttttttaatcgtttactatttgcactacaatggtgtttgacctgtctaatccttatttaacaagtattttctttggttgggggtgggggtggggtttaagagctgcacttaatgtgagctataaaagaactgctacagcacacaaaatagctatttttattattataattataattattattattattttgtaccttaaaaaatagacacatacaccaaagacatttgtgtgagcctttaaacagtctgtctgtggttggtatcattcaccatcaatgagtcaggggttgggattcaaggttgagtagtgtggattgtgttcaggcttaaaagacctgagaagtttggtttttgactccttttacatccatgaaacaggacatttcatactggatgtacagtagttgtacactgttggatatcaagttcaatcaaattcatggaactacatgcttgtatgtgtatatatacattgcttgtgcatatgcatatctgtatgtatatatacatgtattgtaccatgtccatacacattttaagcacttcaggctgtcattttttaatgttcttaaagcaatgaatgtttgtgtgcaaaacacagtatttttaagaaggataggctatagtttttgcttttactctgaactaggtgggcgcatttcaaaaattcggatgggaaaaagcctggaaattccagtgaatattcagcaaggccctctttcattgtacagggatcaaatttcctcctcttttttgtgccccctcccacttctacaagttatcccctgtggggaaaacaggatgataatcaaaactctgggctgatgtttttccaacttagtgtctattggaatcaatcttaaatcagaagctttttcagaaaaataatatttaggccagaattagagttgagtgtattttttaaaaatgattaaggcttggttgtgagaaatattacctgtaccagctgggaaaaataatgtcatcactaactaaaagataattaatttgagagaaagtgttaagagagggagagtaaggaagagaacagttaagaggaggcagaggtgagggcagtagtaaaaatctctaaaattttaatttacagccaaaattcttcatgtgtaaatttgtattgattcagatgcagaaatgaaaaaaaaacacctttgttttataaatatcaaagtacatgcttaaagccaagtttttatctagtttattctagtacttagcttgcctggaatagctaataaattattcatgtatgtgcttttgaaaatccagagccctatttttacacacttgtgtgaagttggcaaacattttgaaaaatggaaaaaagtttctaataattgggaacaattacattaattaatattttgtaaaatattgaagcttttagccctatgtcaatttgtagattaaaataaattaattataggaaaggaagataacagtgagaaaccaaacattacaaaaggtggtttagctctccttgaaaaatatactaagttggtatactataacacttggctatatgtaggcaatgtcactactgggcaaatacacttactgtgttctagaggcagccctttcttatgcagaaaatacaatacgcactgcatgagaagcttgagagtggattctaatccaggtctgtcgaccttggatatcatgcatgtgggaaggtgggtgtggtgagaaaagttttaaggcaagagtagatggccatgttcaactttacaaaatttcttggaaaactggcagtattttgaactgcatcttctttggtaccggaacctgcagaaacagtgtgagaaattaagtcctggttcactgcgcagtagcaaagatggtcaaggccatggaaaaagcagaaatttaccaagaaagctgatacccatgtatagttcccactcatctcaaatacatctgctatctttttaagctaagtcctagacatatcggggataacatgggggttgattagtgaccacagttatcagaagcagagaaatgtaattccatattttatttgaaacttattccatattttaattggatattgagtgattgggttatcaaacacccacaaactttaattttgttaaatttatatggctttgaaatagaagtataagttgctaccattttttgataacattgaaagatagtattttaccatctttaatcatcttggaaaatacaagtcctgtgaacaaccactctttcacctagcagcatgaggccaaaagtaaaggctttaaattataacatatgggattcttagtagtatgtttttttcttgaaactcagtggctctatctaaccttactatctcctcactctttctctaagactaaactctaggctcttaaaaatctgcccacaccaatcttagaagctctgaaaagaatttgtctttaaatatcttttaatagtaacatgtattttatggaccaaattgacattttcgactattttttccaaaaaagtcaggtgaatttcagcacactgagttgggaatttcttatcccagaagaccaaccaatttcatatttatttaagattgattccatactccgttttcaaggagaatccctgcagtctccttaaaggtagaacaaatactttctatttttttttcaccattgtgggattggactttaagaggtgactctaaaaaaacagagaacaaatatgtctcagttgtattaagcacggacccatattatcatattcacttaaaaaaatgatttcctgtgcaccttttggcaacttctcttttcaatgtagggaaaaacttagtcaccctgaaaacccacaaaataaataaaacttgtagatgtgggcagaaggtttgggggtggacattgtatgtgtttaaattaaaccctgtatcactgagaagctgttgtatgggtcagagaaaatgaatgcttagaagctgttcacatcttcaagagcagaagcaaaccacatgtctcagctatattattatttattttttatgcataaagtgaatcatttcttctgtattaatttccaaagggttttaccctctatttaaatgctttgaaaaacagtgcattgacaatgggttgatatttttctttaaaagaaaaatataattatgaaagccaagataatctgaagcctgttttattttaaaactttttatgttctgtggttgatgttgtttgtttgtttgtttctattttgttggttttttactttgttttttgttttgttttgttttgttttgcatactacatgcagttctttaaccaatgtctgtttggctaatgtaattaaagttgttaatttatatgagtgcatttcaactatgtcaatggtttcttaatatttattgtgtagaagtactggtaatttttttatttacaatatgtttaaagagataacagtttgatatgttttcatgtgtttatagcagaagttatttatttctatggcattccagcggatattttggtgtttgcgaggcatgcagtcaatattttgtacagttagtggacagtattcagcaacgcctgatagcttctttggccttatgttaaataaaaagacctgtttgggatgtattttttatttttattttta

SEQ ID NO: 556 - DNA, 1129 bp, Homo sapiens
tacagtataaaacttcacagtgccaataccatgaagaggagctcagacagctcttaccacatgatacaagagccggctggtggaagagtggggaccagaaagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggcacagtgaaatcttgatgaagaatggaaaattaaaggaacagacgctttttacagggaggcttcccccagcccccatcccatggacattccgaggcttaatatatttctgaagcctacagccctgataaacatcaatcccacgtcagtttccagcagtctcatctccccacacccttctgcaatgaaagctaatgtaaaagaaagaaatatgcactgcttaataagtcagaatacaatagaacttgtaaaatgtacctgcatataaggtagacattaggaagacttgaatctctctcttccccctgttctcctgagcattatggcaacagcattttcatgaaattagatctgttttatattttttcctgataaaatatcatgcaatatacaaatagcagttccagaaatggacaccaggagaaggaggcgacaggcatgtcaattagtagggggaaaatccaaatgtcagaaatatgggggagagagaaagcacg

SEQ ID NO: 557 - DNA, 1045 bp, Homo sapiens
tacagtataaaacttcacagtgccaataccatgaagaggagctcagacagctcttaccacatgatacaagagccggctggtggaagagtggggaccagaaagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggacattccgaggcttaatatatttctgaagcctacagccctgataaacatcaatcccacgtcagtttccagcagtctcatctccccacacccttctgcaatgaaagctaatgtaaaagaaagaaatatgcactgcttaataagtcagaatacaatagaacttgtaaaatgtacctgcatataaggtagacattaggaagacttgaatctctctcttccccctgttctcctgagcattatggcaacagcattttcatgaaattagatctgttttatattttttcctgataaaatatcatgcaatatacaaatagcagttccagaaatggacaccaggagaaggaggcgacaggcatgtcaattagtagggggaaaatccaaatgtcagaaatatgggggagagagaaagcacg

SEQ ID NO: 558 - DNA, 531 bp, Artificial
  Synthetic oligonucleotide
agaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcag

SEQ ID NO: 559 - DNA, 412 bp, Artificial
  Synthetic oligonucleotide
gacattccgaggcttaatatatttctgaagcctacagccctgataaacatcaatcccacgtcagtttccagcagtctcatctccccacacccttctgcaatgaaagctaatgtaaaagaaagaaatatgcactgcttaataagtcagaatacaatagaacttgtaaaatgtacctgcatataaggtagacattaggaagacttgaatctctctcttccccctgttctcctgagcattatggcaacagcattttcatgaaattagatctgttttatattttttcctgataaaatatcatgcaatatacaaatagcagttccagaaatggacaccaggagaaggaggcgacaggcatgtcaattagtagggggaaaatccaaatgtcagaaatatgggggagagagaaagcacg

SEQ ID NO: 560 - DNA, 943 bp, Artificial
  Synthetic oligonucleotide
gaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacag

SEQ ID NO: 561 - DNA, 2754 bp, Artificial
  Synthetic oligonucleotide
tggcaaaatgaagaaatttttaaggtttctgagttaaccagaaaaatagaaattaaaaacaaaacaaaaaaaaaaaacaaaaaaaaacaaaagtaaattaaaaacaaaacctgatgaaacagatgaaggaagatgtggaaaaaatccttagccagggctcagagatgaagcagtgaaagagacaggaattgggagggaaagggagaatggtgtaccctttatttcttctgaaatcacactgatgacatcagttgtttaaacggggtattgtcctttccccccttgaggttcccttgtgagccttgaatcaaccaatctagtctgcagtagtgtggactagaacaacccaaatagcatctagaaagccatgagtttgaaagggcccatcacaggcactttcctacccaattacccaggtcataaggtatgtctgtgtgacacttatctctgtgtatatcagcatacacacacacacacacacacacacacacacacaggcatttccacacattacatatatacacatactggtaaaagaacaatcgtgtgcaggtggtcacacttcctttttctgtaccacttttgcaacaaaacaaaacaaacaacattaaaaaattgagaacaagtatggaaagaatgaaagatcaaggaaaaaagaataccaagttacatttcgttaaggtgcttatgatcttagaactatgcaacctaataggtttgaaactgtttacctgagagagaacaaaaagagagacttttttgtattggaagtaatctgattaatttttattttcttcaaggagagatacttgaaaggaatatgtttgtccatctgttggatccaaacatttctatattttgtaaatgttgttgttgttttttttttaatcgtttactatttgcactacaatggtgtttgacctgtctaatccttatttaacaagtattttctttggttgggggtgggggtggggtttaagagctgcacttaatgtgagctataaaagaactgctacagcacacaaaatagctatttttattattataattataattattattattattttgtaccttaaaaaatagacacatacaccaaagacatttgtgtgagcctttaaacagtctgtctgtggttggtatcattcaccatcaatgagtcaggggttgggattcaaggttgagtagtgtggattgtgttcaggcttaaaagacctgagaagtttggtttttgactccttttacatccatgaaacaggacatttcatactggatgtacagtagttgtacactgttggatatcaagttcaatcaaattcatggaactacatgcttgtatgtgtatatatacattgcttgtgcatatgcatatctgtatgtatatatacatgtattgtaccatgtccatacacattttaagcacttcaggctgtcattttttaatgttcttaaagcaatgaatgtttgtgtgcaaaacacagtatttttaagaaggataggctatagtttttgcttttactctgaactaggtgggcgcatttcaaaaattcggatgggaaaaagcctggaaattccagtgaatattcagcaaggccctctttcattgtacagggatcaaatttcctcctcttttttgtgccccctcccacttctacaagttatcccctgtggggaaaacaggatgataatcaaaactctgggctgatgtttttccaacttagtgtctattggaatcaatcttaaatcagaagctttttcagaaaaataatatttaggccagaattagagttgagtgtattttttaaaaatgattaaggcttggttgtgagaaatattacctgtaccagctgggaaaaataatgtcatcactaactaaaagataattaatttgagagaaagtgttaagagagggagagtaaggaagagaacagttaagaggaggcagaggtgagggcagtagtaaaaatctctaaaattttaatttacagccaaaattcttcatgtgtaaatttgtattgattcagatgcagaaatgaaaaaaaaacacctttgttttataaatatcaaagtacatgcttaaagccaagtttttatctagtttattctagtacttagcttgcctggaatagctaataaattattcatgtatgtgcttttgaaaatccagagccctatttttacacacttgtgtgaagttggcaaacattttgaaaaatggaaaaaagtttctaataattgggaacaattacattaattaatattttgtaaaatattgaagcttttagccctatgtcaatttgtagattaaaataaattaattataggaaaggaagataacagtgagaaaccaaacattacaaaaggtggtttagctctccttgaaaaatatactaagttggtatactataacacttggctatatgtaggcaatgtcactactgggcaaatacacttactgtgttctagaggcagccctttcttatgcagaaaatacaatacgcactgcatgagaagcttgagagtggattctaatccaggtctgtcgaccttggatatcatgcatgtgggaaggtgggtgtggtgagaaaagttttaaggcaagagtagatggccatgttcaactttacaaaatttcttggaaaactggcagtattttgaactgcatcttctttggtaccggaacctgcagaaacagtgtgagaaattaagtcctggttcactgcgcagtagcaaagatggtcaaggccatggaaa

SEQ ID NO: 562 - DNA, 1691 bp, Artificial
  Synthetic oligonucleotide
atctgctatctttttaagctaagtcctagacatatcggggataacatgggggttgattagtgaccacagttatcagaagcagagaaatgtaattccatattttatttgaaacttattccatattttaattggatattgagtgattgggttatcaaacacccacaaactttaattttgttaaatttatatggctttgaaatagaagtataagttgctaccattttttgataacattgaaagatagtattttaccatctttaatcatcttggaaaatacaagtcctgtgaacaaccactctttcacctagcagcatgaggccaaaagtaaaggctttaaattataacatatgggattcttagtagtatgtttttttcttgaaactcagtggctctatctaaccttactatctcctcactctttctctaagactaaactctaggctcttaaaaatctgcccacaccaatcttagaagctctgaaaagaatttgtctttaaatatcttttaatagtaacatgtattttatggaccaaattgacattttcgactattttttccaaaaaagtcaggtgaatttcagcacactgagttgggaatttcttatcccagaagaccaaccaatttcatatttatttaagattgattccatactccgttttcaaggagaatccctgcagtctccttaaaggtagaacaaatactttctatttttttttcaccattgtgggattggactttaagaggtgactctaaaaaaacagagaacaaatatgtctcagttgtattaagcacggacccatattatcatattcacttaaaaaaatgatttcctgtgcaccttttggcaacttctcttttcaatgtagggaaaaacttagtcaccctgaaaacccacaaaataaataaaacttgtagatgtgggcagaaggtttgggggtggacattgtatgtgtttaaattaaaccctgtatcactgagaagctgttgtatgggtcagagaaaatgaatgcttagaagctgttcacatcttcaagagcagaagcaaaccacatgtctcagctatattattatttattttttatgcataaagtgaatcatttcttctgtattaatttccaaagggttttaccctctatttaaatgctttgaaaaacagtgcattgacaatgggttgatatttttctttaaaagaaaaatataattatgaaagccaagataatctgaagcctgttttattttaaaactttttatgttctgtggttgatgttgtttgtttgtttgtttctattttgttggttttttactttgttttttgttttgttttgttttgttttgcatactacatgcagttctttaaccaatgtctgtttggctaatgtaattaaagttgttaatttatatgagtgcatttcaactatgtcaatggtttcttaatatttattgtgtagaagtactggtaatttttttatttacaatatgtttaaagagataacagtttgatatgttttcatgtgtttatagcagaagttatttatttctatggcattccagcggatattttggtgtttgcgaggcatgcagtcaatattttgtacagttagtggacagtattcagcaacgcctgatagcttctttggccttatgttaaataaaaagacctgtttgggatgtattttttatttttattttta

SEQ ID NO: 563 - DNA, 102 bp, Artificial
  Synthetic oligonucleotide
tacagtataaaacttcacagtgccaataccatgaagaggagctcagacagctcttaccacatgatacaagagccggctggtggaagagtggggaccagaaag

SEQ ID NO: 564 - DNA, 84 bp, Artificial
  Synthetic oligonucleotide
gcacagtgaaatcttgatgaagaatggaaaattaaaggaacagacgctttttacagggaggcttcccccagcccccatcccatg

SEQ ID NO: 565 - DNA, 59 bp, Artificial
  Synthetic oligonucleotide
aagcagaaatttaccaagaaagctgatacccatgtatagttcccactcatctcaaatac

SEQ ID NO: 566 - protein, 426 aa, Homo sapiens
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 567 - protein, 134 aa, Homo sapiens
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTVKS

SEQ ID NO: 568 - protein, 134 aa, Homo sapiens
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGHSEA

SEQ ID NO: 569 - protein, 134 aa, Homo sapiens; identical to SEQ ID NO: 567

SEQ ID NO: 570 - DNA, 2199 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgaaaaaaaagckataat

SEQ ID NO: 571 - DNA, 1947 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgaaaaaaaagckataat

SEQ ID NO: 572 - DNA, 1592 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaaggtgccaggggctgtgggccagggtagaaagcatctagggagggtttgagagctattgctcccagggacagggtggacagggaagctggacccagggccctgcaggacctggtgggagctctgtgagcacagggcagccccaagactccaggtcctgggcagtgaacct

SEQ ID NO: 573 - DNA, 2490 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagggtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcagggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgaaaaaaaagckataat

SEQ ID NO: 574 - DNA, 810 bp, Artificial
  Synthetic oligonucleotide
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctgg

SEQ ID NO: 575 - DNA, 168 bp, Artificial
  Synthetic oligonucleotide
gtgccaggggctgtgggccagggtagaaagcatctagggagggtttgagagctattgctcccagggacagggtggacagggaagctggacccagggccctgcaggacctggtgggagctctgtgagcacagggcagccccaagactccaggtcctgggcagtgaacct

SEQ ID NO: 576 - DNA, 157 bp, Artificial
  Synthetic oligonucleotide
ggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagg

SEQ ID NO: 577 - DNA, 198 bp, Artificial
  Synthetic oligonucleotide
gtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcag

SEQ ID NO: 578 - DNA, 153 bp, Artificial
  Synthetic oligonucleotide
ggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctg

SEQ ID NO: 579 - DNA, 140 bp, Artificial
  Synthetic oligonucleotide
gccatcccgcgccacgtggctgtccttgttctccagtgaggagagcaacttgggagccaacaactatgatgactacaggatggactggcttgtgcctgccacctgtgaacccatccagagtgtcttcttcttctctggag

SEQ ID NO: 580 - DNA, 127 bp, Artificial
  Synthetic oligonucleotide
acaagtactaccgagtcaatcttcgcacacggcgagtggacactgtggaccctccctacccacgctccatcgctcagtactggctgggctgcccagctcctggccatctgtaggagtcagagcccac

SEQ ID NO: 581 - DNA, 223 bp, Artificial
  Synthetic oligonucleotide
tgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggataga

SEQ ID NO: 582 - DNA, 9 bp, Artificial
  Synthetic oligonucleotide
ctgaccaag

SEQ ID NO: 583 - DNA, 44 bp, Artificial
  Synthetic oligonucleotide
ggagacctcagcccccagcagaggaggagctgtgcagtgggaag

SEQ ID NO: 584 - DNA, 38 bp, Artificial
  Synthetic oligonucleotide
cccttcgacgccttcaccgacctcaagaacggttccct

SEQ ID NO: 585 - DNA, 14 bp, Artificial
  Synthetic oligonucleotide
ctttgccttccgag

SEQ ID NO: 586 - DNA, 32 bp, Artificial
  Synthetic oligonucleotide
ggcagtactgctatgaactggacgaaaaggca

SEQ ID NO: 587 - DNA, 24 bp, Artificial
  Synthetic oligonucleotide
gtgaggcctgggtaccccaagctc

SEQ ID NO: 588 - DNA, 84 bp, Artificial
  Synthetic oligonucleotide
atccgagatgtctggggcatcgagggccccatcgatgccgccttcacccgcatcaactgtcaggggaagacctacctcttcaag

SEQ ID NO: 589 - DNA, 42 bp, Artificial
  Synthetic oligonucleotide
ctggtaccagacagccccagttcattagccgggactggcacg

SEQ ID NO: 590 - DNA, 51 bp, Artificial
  Synthetic oligonucleotide
gtgtgccagggcaagtggacgcagccatggctggccgcatctacatctcag

SEQ ID NO: 591 - DNA, 9 bp, Artificial
  Synthetic oligonucleotide
gcatggcac

SEQ ID NO: 592 - DNA, 95 bp, Artificial
  Synthetic oligonucleotide
cccgcccctccttggccaagaaacaaaggtttaggcatcgcaaccgcaaaggctaccgttcacaacgaggccacagccgtggccgcaaccagaac

SEQ ID NO: 593 - DNA, 42 bp, Artificial
  Synthetic oligonucleotide
agtcatgcaagggccgctgcactgagggcttcaacgtggaca

SEQ ID NO: 594 - DNA, 8 bp, Artificial
  Synthetic oligonucleotide
tcccgccg

SEQ ID NO: 595 - DNA, 7 bp, Artificial
  Synthetic oligonucleotide
atggccg

SEQ ID NO: 596 - DNA, 17 bp, Artificial
  Synthetic oligonucleotide
ggccctctgtagctccc

SEQ ID NO: 597 - DNA, 62 bp, Artificial
  Synthetic oligonucleotide
tcctcccatctccttcccccagcccaataaaggtcccttagccccgaaaaaaaagckataat

SEQ ID NO: 598 - DNA, 20 bp, Artificial
  Synthetic oligonucleotide
agaagtgccagtgtgacgag

SEQ ID NO: 599 - DNA, 58 bp, Artificial
  Synthetic oligonucleotide
ctctgctcttactaccagagctgctgcacagactatacggctgagtgcaagccccaag

SEQ ID NO: 600 - DNA, 6 bp, Artificial
  Synthetic oligonucleotide
ctcaag

SEQ ID NO: 601 - DNA, 20 bp, Artificial
  Synthetic oligonucleotide
gcctgagacccttcatccag

SEQ ID NO: 602 - protein, 478 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 603 - protein, 283 aa, Homo sapiens [sequence omitted]

SEQ ID NO: 604 - protein, 447 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 605 - protein, 363 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSDKYYRVNLRTRRVDTVDPPYPRSIAQYWLGCPAPGHL

SEQ ID NO: 606 - protein, 238 aa, Homo sapiens [sequence omitted]

SEQ ID NO: 607 - DNA, 3429 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccatatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaacta

SEQ ID NO: 608 - DNA, 5165 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacaggatgcaatggtggtgtcctccagacccaaagccacaacccatcgcaagtcaagaacactttccagaagataaacatgagtgggttcatgtctctctccttcaaagccaggacaaaatccccacttctttgctgccgcgagtcaatttgtgatttattttgtctgcacctgtttgatgccaggtcgacatttcctaaggcaagcccctgtatttgttgtggatttaagtggaggcggccagcacacaccttggatgtaatttaaaaccatttcctgaggaaagatgtgtgatatgctttcctttgtttagcaaatgtttatggttttaactttaaatctcaccgcaaatcacttacacttgaaaacagggctggtctgaaagtaattaccctccctgagtgccaagacctccagaagttgttttcattcccgaatggcaatcactgtactcatgcgctccacgcatcttaaataaactcagttcaaagcacatgcctcctgcttcagctcttttttccaaaaagagaaacagaagcaggttccccctccttttatagtgcctgcgtggacacgcggacctccatgcctttcatgctgtggctatgtcagcaaactacgatattgggatgatcctaacgggcaagccagctgcggctcctaccggccgtggccattgaaggccaccatgttgctttgaaacatctcaaagaataacatagtgccagccagcaagggtttcaccatatgcatgacccagacaggaactatcaaaagaagggatcacgggaaggtgcatgatgctaatgtggaatccagaggagctctttcctgatctcttcagcttccgctgccactccagaatcatcagagctgatattaaataagttaaaatgttagtccaccgtctcctcctgcaatcctaaccatcttttgagactgttagaatactttgacgggttgtctttctgtgcaactaatttaaacctcaagtttagtgtaggagatgggtttgtcttctcacctcttcagatctttatcaagggggaataaaagccaacccagaaacctaaactttaaaatttaattatttgaaataataaaacagaagaagggatcaacatttgtcggaattggcactcttggaaaactaagtctaggagatcatatattgctttttttttttcattctaaattacttttaattgaaagtcaagatgctgagttacagttgtttatcattataataagcaaactttttaagttggatttcttcttaaagaggtaaactagtgaacaaaaaagataaaaaggaaaattaagaatcaactatgcctttatcaaatttgaagcataagttatattattaaaattatttttgtataatcaaggtgataagacattctggaaaacatttaatgtatttagtacttagaatatttacagtggatgttacttttttgaaacgatatatttttcccaatttttctatcatgtcaaggaaggaaactgttaagaagttaccagtgtccaaaatgtcttcattgtttcttactcatacttacacctcacatgacctgcccagccctctttggttcagttcattcccagaagccaagccttagtcttcacagatgagcgacacacacctctgaatataatgtctcttttttgttttttccttttcagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccatatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaacta

SEQ ID NO: 609 - DNA, 3575 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacagaagtaagagaaacctgtgatggccagagcccagatgttcttaggaggcaagccaggagaagccgggtctgacttttcagctcagagacagcactcccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccatatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaacta

SEQ ID NO: 610 - DNA, 2397 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacaggatgcaatggtggtgtcctccagacccaaagccacaacccatcgcaagtcaagaacactttccagaagataaacatgagtgggttcatgtctctctccttcaaagccaggacaaaatccccacttctttgctgccgcgagtcaatttgtgatttattttgtctgcacctgtttgatgccaggtcgacatttcctaaggcaagcccctgtatttgttgtggatttaagtggaggcggccagcacacaccttggatgtaatttaaaaccatttcctgaggaaagatgtgtgatatgctttcctttgtttagcaaatgtttatggttttaactttaaatctcaccgcaaatcacttacacttgaaaacagggctggtctgaaagtaattaccctccctgagtgccaagacctccagaagttgttttcattcccgaatggcaatcactgtactcatgcgctccacgcatcttaaataaactcagttcaaagca

SEQ ID NO: 611 - DNA, 2206 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagctactgtggttgagaggaaaggtgtctttttattgcttctagagacgttgaaagtgtgacctgagcacctcataatcatgtgaaaaagacactcaaaaactaccatttgaatggatggatgaaaataacctccgtatattctacgaagatgtttaataataaataggtttcgttataagagaatgtgtgtcacttcgtctcttccctcacccccgagacttagtgacagttatttttgacttttccaactatactatttgcctagaaaatgtgtctattaaatagcgtattgagaaat

SEQ ID NO: 612 - DNA, 669 bp, Artificial
  Synthetic oligonucleotide
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacg

SEQ ID NO: 613 - DNA, 187 bp, Artificial
  Synthetic oligonucleotide
tgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaag

SEQ ID NO: 614 - DNA, 172 bp, Artificial
  Synthetic oligonucleotide
tttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaag

SEQ ID NO: 615 - DNA, 275 bp, Artificial
  Synthetic oligonucleotide
gctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccaca

SEQ ID NO: 616 - DNA, 1685 bp, Artificial
  Synthetic oligonucleotide
gatgcaatggtggtgtcctccagacccaaagccacaacccatcgcaagtcaagaacactttccagaagataaacatgagtgggttcatgtctctctccttcaaagccaggacaaaatccccacttctttgctgccgcgagtcaatttgtgatttattttgtctgcacctgtttgatgccaggtcgacatttcctaaggcaagcccctgtatttgttgtggatttaagtggaggcggccagcacacaccttggatgtaatttaaaaccatttcctgaggaaagatgtgtgatatgctttcctttgtttagcaaatgtttatggttttaactttaaatctcaccgcaaatcacttacacttgaaaacagggctggtctgaaagtaattaccctccctgagtgccaagacctccagaagttgttttcattcccgaatggcaatcactgtactcatgcgctccacgcatcttaaataaactcagttcaaagcacatgcctcctgcttcagctcttttttccaaaaagagaaacagaagcaggttccccctccttttatagtgcctgcgtggacacgcggacctccatgcctttcatgctgtggctatgtcagcaaactacgatattgggatgatcctaacgggcaagccagctgcggctcctaccggccgtggccattgaaggccaccatgttgctttgaaacatctcaaagaataacatagtgccagccagcaagggtttcaccatatgcatgacccagacaggaactatcaaaagaagggatcacgggaaggtgcatgatgctaatgtggaatccagaggagctctttcctgatctcttcagcttccgctgccactccagaatcatcagagctgatattaaataagttaaaatgttagtccaccgtctcctcctgcaatcctaaccatcttttgagactgttagaatactttgacgggttgtctttctgtgcaactaatttaaacctcaagtttagtgtaggagatgggtttgtcttctcacctcttcagatctttatcaagggggaataaaagccaacccagaaacctaaactttaaaatttaattatttgaaataataaaacagaagaagggatcaacatttgtcggaattggcactcttggaaaactaagtctaggagatcatatattgctttttttttttcattctaaattacttttaattgaaagtcaagatgctgagttacagttgtttatcattataataagcaaactttttaagttggatttcttcttaaagaggtaaactagtgaacaaaaaagataaaaaggaaaattaagaatcaactatgcctttatcaaatttgaagcataagttatattattaaaattatttttgtataatcaaggtgataagacattctggaaaacatttaatgtatttagtacttagaatatttacagtggatgttacttttttgaaacgatatatttttcccaatttttctatcatgtcaaggaaggaaactgttaagaagttaccagtgtccaaaatgtcttcattgtttcttactcatacttacacctcacatgacctgcccagccctctttggttcagttcattcccagaagccaagccttagtcttcacagatgagcgacacacacctctgaatataatgtctcttttttgttttttccttttcag

SEQ ID NO: 617 - DNA, 877 bp, Artificial
  Synthetic oligonucleotide
ccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccatatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctc

SEQ ID NO: 618 - DNA, 252 bp, Artificial
  Synthetic oligonucleotide
gatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaag

SEQ ID NO: 619 - DNA, 349 bp, Artificial
  Synthetic oligonucleotide
gaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaacta

SEQ ID NO: 620 - DNA, 233 bp, Artificial
  Synthetic oligonucleotide
cacctcataatcatgtgaaaaagacactcaaaaactaccatttgaatggatggatgaaaataacctccgtatattctacgaagatgtttaataataaataggtttcgttataagagaatgtgtgtcacttcgtctcttccctcacccccgagacttagtgacagttatttttgacttttccaactatactatttgcctagaaaatgtgtctattaaatagcgtattgagaaat

SEQ ID NO: 621 - DNA, 51 bp, Artificial
  Synthetic oligonucleotide
atgatgccgcagctccagcgttggagactcagcctcaaggagatgaagaag

SEQ ID NO: 622 - DNA, 75 bp, Artificial
  Synthetic oligonucleotide
atattgcatcacgttaccctaccctttggactgaacaggttaaaagtcggcagaacaaaaccaataagaattcag

SEQ ID NO: 623 - DNA, 83 bp, Artificial
  Synthetic oligonucleotide
gtacgagcagccgaaatgtgacaacacggccagggcccacccagccaaagcccgggacctgtacaagggccgccagctacaag

SEQ ID NO: 624 - DNA, 103 bp, Artificial
  Synthetic oligonucleotide
gttgtccgggtgccaaaaagcatgagtttctgaccagcgttctggacgcgctgtccacggacatggtccacgccgcctccgacccctcctcctcgtcaggcag

SEQ ID NO: 625 - DNA, 95 bp, Artificial
  Synthetic oligonucleotide
gaagtaagagaaacctgtgatggccagagcccagatgttcttaggaggcaagccaggagaagccgggtctgacttttcagctcagagacagcact

SEQ ID NO: 626 - DNA, 38 bp, Artificial
  Synthetic oligonucleotide
cccccagaggtcatgctgaaagtacgtctaatagacag

SEQ ID NO: 627 - DNA, 75 bp, Artificial
  Synthetic oligonucleotide
ctgatcctcctacctggtccaccccagggctaccggaaggtaaaatcttcacctgaaccaattatgagcagtctc

SEQ ID NO: 628 - DNA, 19 bp, Artificial
  Synthetic oligonucleotide
cttactgaaggtacagccg

SEQ ID NO: 629 - DNA, 65 bp, Artificial
  Synthetic oligonucleotide
ctactgtggttgagaggaaaggtgtctttttattgcttctagagacgttgaaagtgtgacctgag

SEQ ID NO: 630 - DNA, 107 bp, Artificial
  Synthetic oligonucleotide
acgtgtccaggtgtgtggccgaaaggaagtatacccaggagcaagcccggaaggagtttcagcaagtgttcattcctgagtgcaatgacgacggcacctacagtcag

SEQ ID NO: 631 - DNA, 100 bp, Artificial
  Synthetic oligonucleotide
gtccagtgtcacagctacacgggatactgctggtgcgtcacgcccaacgggaggcccatcagcggcactgccgtggcccacaagacgccccggtgcccgg

SEQ ID NO: 632 - DNA, 48 bp, Artificial
  Synthetic oligonucleotide
gttccgtaaatgaaaagttaccccaacgcgaaggcacaggaaaaacag

SEQ ID NO: 633 - protein, 446 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 634 - protein, 464 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQDAMVVSSRPKATTHRKSRTLSRR

SEQ ID NO: 635 - protein, 434 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHRSKRNL

SEQ ID NO: 636 - protein, 454 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQLLWLRGKVSFYCF

SEQ ID NO: 637 - protein, 429 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 638 - DNA, 2110 bp, Homo sapiens
tctgcaggaggggagctgggaacgacctgagctaaagctcggagctgtgcgaagaaaccggaaaagcccagagcacttgcaggggcgggtggggagctagatggtggggtggggtggggacggaggagggccagcaggagacattccgcagggaggggcaagcacgtgtgaggcgggcggggcgcgaagggtcaggcttttgctcaaaacaggcagaggacaaggtcagctcagccgcagaccgagccgctggtgactgtctccgccaccaggcagtgagagtgaagggagagcgcgagctctgaagcccgctagactaagcttgcaatctgagctccattcaccccctcctatttcttgagaccttgtcagttcccctgtgagcctcggactcctcacttgtaaaacgaggacagatgcccgtgccagaagtcaaccagagctttccccggcgtgggcaccagcccaagggcgttttgcttttctagtctcatctctgctctgacgctaagctcaaagagggactgggggacgggaagatatccaccatggcatgcgccctagctctcgggctggtgttggctgcttccttctcagattccagagtgcctagaggccaggaaagggagaaggtcctaccagcctggggtagggactcgggggccaggcactggcgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctggtaagatgggcaactttggagctatatctgattggttattactactgctctttcagccaagcctgttctaaaaagccaagtcctcccctgagagctgtagaagctgggacaagagagtggttgtgggtcagggtggtatcaggtgggaattttctgtgtagtggctttggactcacacaggccggaactcaaatcttaccttataggctacatgactgtgggcaaatcaccttttccaagtgcaactgtaaaacgggtattaataataccaaccttgtagggctgctgggaagcctgtaagagacagtgtatgcacagcacaaagcatcactgattgaggaacacagcaggtgctccatgtcctttgtttgctcttcctgtgtttctaccttgcctcacctcaggaagaagtagaaaacagggccaaatctgatcccaggccctctaggaggggctcccattgcctatctcagcattccctttcctctcctccctaggactgcattgtcacttgcagggacaggctcgtgactggtggggacactgaatgacagtacagtcctttcttccccattctagtcctaccccattttcatgctttctatgtctggcctactgaaactacttgactactgcttgggtaggaagtaccacagccaggctggcagatctgttcaagcttggggacttcacttggagaatctagccttgactgaattccccccagacccagggagagcagccaactgtggattctgcctaaccacagggcctcaggttttcacctaggcatcttcactgcacaccttcttgggtcagcataacctgttaactgcat

SEQ ID NO: 639 - DNA, 1733 bp, Homo sapiens
tctgcaggaggggagctgggaacgacctgagctaaagctcggagctgtgcgaagaaaccggaaaagcccagagcacttgcaggggcgggtggggagctagatggtggggtggggtggggacggaggagggccagcaggagacattccgcagggaggggcaagcacgtgtgaggcgggcggggcgcgaagggtcaggcttttgctcaaaacaggcagaggacaaggtcagctcagccgcagaccgagccgctggtgactgtctccgccaccaggcagtgagagtgaagggagagcgcgagctctgaagcccgctagactaagcttgcaatctgagctccattcaccccctcctatttcttgagaccttgtcagttcccctgtgagcctcggactcctcacttgtaaaacgaggacagatgcccgtgccagaagtcaaccagagctttccccggcgtgggcaccagcccaagggcgttttgcttttctagtctcatctctgctctgacgctaagctcaaagagggactgggggacgggaagatatccaccatggcatgcgccctagctctcgggctggtgttggctgcttccttctcagattccagagtgcctagaggccaggaaagggagaaggtcctaccagcctggggtagggactcgggggccaggcactggcgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctggatgttctgacagcctggccaagcatctacaggagacaagtcaaagttttaagagaagatgaaataacaattcttccttggcatctccaatggagtagagagaaggcaacaaagcttctcagacccacattaccgagctataacaaccatggctgggaggagctgagagttggcaaatcaatagtttagctatgttgctgaaccttcctggatggcaagaccatggaagtccatcacaagatattatggggtcaggagcctcactgggttctgccccttatataggtgaatatcctgggaaagtaaaaatgaaaatacagagtctggcaccagttccctgcaagcctggtccagcctggataaagaagtgaggagagtaataatactgccttacacctaaacagtgctttagtttatcaagctttttgcatccttatcttacaataatagtctgtagagtc

SEQ ID NO: 640 - DNA, 1822 bp, Homo sapiens
tctgcaggaggggagctgggaacgacctgagctaaagctcggagctgtgcgaagaaaccggaaaagcccagagcacttgcaggggcgggtggggagctagatggtggggtggggtggggacggaggagggccagcaggagacattccgcagggaggggcaagcacgtgtgaggcgggcggggcgcgaagggtcaggcttttgctcaaaacaggcagaggacaaggtcagctcagccgcagaccgagccgctggtgactgtctccgccaccaggcagtgagagtgaagggagagcgcgagctctgaagcccgctagactaagcttgcaatctgagctccattcaccccctcctatttcttgagaccttgtcagttcccctgtgagcctcggactcctcacttgtaaaacgaggacagatgcccgtgccagaagtcaaccagagctttccccggcgtgggcaccagcccaagggcgttttgcttttctagtctcatctctgctctgacgctaagctcaaagagggactgggggacgggaagatatccaccatggcatgcgccctagctctcgggctggtgttggctgcttccttctcagattccagagtgcctagaggccaggaaagggagaaggtcctaccagcctggggtagggactcgggggccaggcactggcgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctgatggaaaaactgcaactcagaaatgtaaagtgagtcgaccaaggctaaagcggcaaaaccactatactttataacacagagtttggcactatttccactttgttctctctcaaagatgaaggctcaggaggagggaagataaaaacaaatcactggagagtcctggcatgctggaacatggactctagctagcaagaagggctcaaggaggtggccttctcctagacctcaactttgatgcaaaagctgttttgcagcctgaacaaagacaatccaatcctccagcaaatggcgtcattttccctacgtgtctagccttgagctacagaacaaaagaacaatcacatccgaagttgtagttcgcctggttgcggtggctcacgcctgtgatcccagcactttgggaggccaaggtgggtggatcacctgaggtcaggaggtcgagactagcctgaccaacatgaagaaaccccatctctactaaaaatacaaaattagctgggcgtggtggcacatgcctgtaatcccagctactcgggaggctgaggca

SEQ ID NO: 641 - DNA, 3531 bp, Homo sapiens
tctgcaggaggggagctgggaacgacctgagctaaagctcggagctgtgcgaagaaaccggaaaagcccagagcacttgcaggggcgggtggggagctagatggtggggtggggtggggacggaggagggccagcaggagacattccgcagggaggggcaagcacgtgtgaggcgggcggggcgcgaagggtcaggcttttgctcaaaacaggcagaggacaaggtcagctcagccgcagaccgagccgctggtgactgtctccgccaccaggcagtgagagtgaagggagagcgcgagctctgaagcccgctagactaagcttgcaatctgagctccattcaccccctcctatttcttgagaccttgtcagttcccctgtgagcctcggactcctcacttgtaaaacgaggacagatgcccgtgccagaagtcaaccagagctttccccggcgtgggcaccagcccaagggcgttttgcttttctagtctcatctctgctctgacgctaagctcaaagagggactgggggacgggaagatatccaccatggcatgcgccctagctctcgggctggtgttggctgcttccttctcagattccagagtgcctagaggccaggaaagggagaaggtcctaccagcctggggtagggactcgggggccaggcactggcgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcgctcatatactcataaccttccccctaccctcaggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctgacactcacccacggcactgcagtttgcactcgcacttatgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggttttttttttttttttttaactgcactcatagggtgctctgaggtcaataaagcagagccaaggccacccagttgcctttttgcctttggtaacataactctgggagtcttggtttatcctgtgtgtcagagagtgggcagaaataacggcctgaaggttactgaggaagaagcactggatgggagactgaaatggacagtctcggagcctgttaatcagctgatcaccttacacatttaataataaaagagctgtacctacacgttgcctttacactgccccccctccatggtcaaatgacctagttcagtcagtgatggggcttccccaggtttggctattgaactgtcacttcaggcccatcctacactgaaagctcttgggtctggctgttctctgtgaaatgctgtagtctctccctttccagaattcaggttcagggcacagaacccaggcttgtaccatggtggtgggagaaaatgaccactggccaagaggactgctgacctgtgcaccaggctagtacttatgactacaaattcttactgcttctctaatcaactctgagggaagagggcatctgatcattacaaaagggagggcttataagtgatctcccaagaaggcagtgatctgctagtgcctttggctctgtacctctgctgggcatctctccaaggtctaaggtaacatattaaatgtttttgtcagctaatgcaggctcagtgactttaagtctgtaagttacccaggaagaaggattataggaaaaataactcagtaagtttaaaaccaaacacatttccatttagtgacaggaatttaagcaaggacctgaagtagaatcaactgattcacacagtagtaaatacaaagtagaacaatgatcttggcttcgctgtctggttcagtggtctgctggaatgcaatacacaagttaagtcacactgcagactgttttctagctgtggccgctggatgccacttctagcatagtagaactatgttaggaggaatgggaaaagtgagcaccacttctcaccatgttcccccctcctgctgccagtctctgctcccatgttggatgcagcagagatcacccaccagttggcccaggacagaccaataggaagggtccaatcactctaactacagccgaactcacctccacaacagtctctgtggctctagcctggactcctttacaggaatccagctctggcagtggcagctggagagggtaatagggcctcctgctgaatgaaggaagttgggtgaatgaatgggtgagctgcagggttcacttgcaaagggaccaggagtgataaggaaacaacaactcattcaggcagctgcttttgacctctaactcccaaacctgcctgttgcatgaggggaagccatctcccatgggagcgaagttaatggggtgggaggctatattctcactattgagtctttccaggagtctcaaggcacaaggctcctggtttcttactctcaaccaccccctacactctttatactctcactccttgtgcttcttcttgtgcttcttcttctttttcttcttctttgctgccttgctgtcttttgatgtgtgccttgccctcttgcctgtatcactctcagagtctgagctgtcagagtcagatgacttcctatctctatgtttctttttcttcttctcctgaaaagaaaattttaaaaatcaacactgtatgtgtatatttgcttttaacaatcatagcacataattggccaggtgcagtggctcacacctgtaatcctagtactttgggaagccgaggtgggaggaatgcttgaggccaggagttcaagatcaacctggctaacatagcaagatctcatctctaaaaagagaaaaaaagaaaaattatagcacacaatcaataggggaccacttaattttcttttagacagtctcgctctgttgcccaggctagagtgcagtgcagtggcacgatcacagctcactgcaacctca

SEQ ID NO: 642 - DNA, 997 bp, Artificial
  Synthetic oligonucleotide
tctgcaggaggggagctgggaacgacctgagctaaagctcggagctgtgcgaagaaaccggaaaagcccagagcacttgcaggggcgggtggggagctagatggtggggtggggtggggacggaggagggccagcaggagacattccgcagggaggggcaagcacgtgtgaggcgggcggggcgcgaagggtcaggcttttgctcaaaacaggcagaggacaaggtcagctcagccgcagaccgagccgctggtgactgtctccgccaccaggcagtgagagtgaagggagagcgcgagctctgaagcccgctagactaagcttgcaatctgagctccattcaccccctcctatttcttgagaccttgtcagttcccctgtgagcctcggactcctcacttgtaaaacgaggacagatgcccgtgccagaagtcaaccagagctttccccggcgtgggcaccagcccaagggcgttttgcttttctagtctcatctctgctctgacgctaagctcaaagagggactgggggacgggaagatatccaccatggcatgcgccctagctctcgggctggtgttggctgcttccttctcagattccagagtgcctagaggccaggaaagggagaaggtcctaccagcctggggtagggactcgggggccaggcactggcgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcg

SEQ ID NO: 643 - DNA, 838 bp, Artificial
  Synthetic oligonucleotide
gtaagatgggcaactttggagctatatctgattggttattactactgctctttcagccaagcctgttctaaaaagccaagtcctcccctgagagctgtagaagctgggacaagagagtggttgtgggtcagggtggtatcaggtgggaattttctgtgtagtggctttggactcacacaggccggaactcaaatcttaccttataggctacatgactgtgggcaaatcaccttttccaagtgcaactgtaaaacgggtattaataataccaaccttgtagggctgctgggaagcctgtaagagacagtgtatgcacagcacaaagcatcactgattgaggaacacagcaggtgctccatgtcctttgtttgctcttcctgtgtttctaccttgcctcacctcaggaagaagtagaaaacagggccaaatctgatcccaggccctctaggaggggctcccattgcctatctcagcattccctttcctctcctccctaggactgcattgtcacttgcagggacaggctcgtgactggtggggacactgaatgacagtacagtcctttcttccccattctagtcctaccccattttcatgctttctatgtctggcctactgaaactacttgactactgcttgggtaggaagtaccacagccaggctggcagatctgttcaagcttggggacttcacttggagaatctagccttgactgaattccccccagacccagggagagcagccaactgtggattctgcctaaccacagggcctcaggttttcacctaggcatcttcactgcacaccttcttgggtcagcataacctgttaactgcat

SEQ ID NO: 644 - DNA, 2226 bp, Artificial
  Synthetic oligonucleotide
acactcacccacggcactgcagtttgcactcgcacttatgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggttttttttttttttttttaactgcactcatagggtgctctgaggtcaataaagcagagccaaggccacccagttgcctttttgcctttggtaacataactctgggagtcttggtttatcctgtgtgtcagagagtgggcagaaataacggcctgaaggttactgaggaagaagcactggatgggagactgaaatggacagtctcggagcctgttaatcagctgatcaccttacacatttaataataaaagagctgtacctacacgttgcctttacactgccccccctccatggtcaaatgacctagttcagtcagtgatggggcttccccaggtttggctattgaactgtcacttcaggcccatcctacactgaaagctcttgggtctggctgttctctgtgaaatgctgtagtctctccctttccagaattcaggttcagggcacagaacccaggcttgtaccatggtggtgggagaaaatgaccactggccaagaggactgctgacctgtgcaccaggctagtacttatgactacaaattcttactgcttctctaatcaactctgagggaagagggcatctgatcattacaaaagggagggcttataagtgatctcccaagaaggcagtgatctgctagtgcctttggctctgtacctctgctgggcatctctccaaggtctaaggtaacatattaaatgtttttgtcagctaatgcaggctcagtgactttaagtctgtaagttacccaggaagaaggattataggaaaaataactcagtaagtttaaaaccaaacacatttccatttagtgacaggaatttaagcaaggacctgaagtagaatcaactgattcacacagtagtaaatacaaagtagaacaatgatcttggcttcgctgtctggttcagtggtctgctggaatgcaatacacaagttaagtcacactgcagactgttttctagctgtggccgctggatgccacttctagcatagtagaactatgttaggaggaatgggaaaagtgagcaccacttctcaccatgttcccccctcctgctgccagtctctgctcccatgttggatgcagcagagatcacccaccagttggcccaggacagaccaataggaagggtccaatcactctaactacagccgaactcacctccacaacagtctctgtggctctagcctggactcctttacaggaatccagctctggcagtggcagctggagagggtaatagggcctcctgctgaatgaaggaagttgggtgaatgaatgggtgagctgcagggttcacttgcaaagggaccaggagtgataaggaaacaacaactcattcaggcagctgcttttgacctctaactcccaaacctgcctgttgcatgaggggaagccatctcccatgggagcgaagttaatggggtgggaggctatattctcactattgagtctttccaggagtctcaaggcacaaggctcctggtttcttactctcaaccaccccctacactctttatactctcactccttgtgcttcttcttgtgcttcttcttctttttcttcttctttgctgccttgctgtcttttgatgtgtgccttgccctcttgcctgtatcactctcagagtctgagctgtcagagtcagatgacttcctatctctatgtttctttttcttcttctcctgaaaagaaaattttaaaaatcaacactgtatgtgtatatttgcttttaacaatcatagcacataattggccaggtgcagtggctcacacctgtaatcctagtactttgggaagccgaggtgggaggaatgcttgaggccaggagttcaagatcaacctggctaacatagcaagatctcatctctaaaaagagaaaaaaagaaaaattatagcacacaatcaataggggaccacttaattttcttttagacagtctcgctctgttgcccaggctagagtgcagtgcagtggcacgatcacagctcactgcaacctca

SEQ ID NO: 645 - DNA, 461 bp, Artificial
  Synthetic oligonucleotide
gatgttctgacagcctggccaagcatctacaggagacaagtcaaagttttaagagaagatgaaataacaattcttccttggcatctccaatggagtagagagaaggcaacaaagcttctcagacccacattaccgagctataacaaccatggctgggaggagctgagagttggcaaatcaatagtttagctatgttgctgaaccttcctggatggcaagaccatggaagtccatcacaagatattatggggtcaggagcctcactgggttctgccccttatataggtgaatatcctgggaaagtaaaaatgaaaatacagagtctggcaccagttccctgcaagcctggtccagcctggataaagaagtgaggagagtaataatactgccttacacctaaacagtgctttagtttatcaagctttttgcatccttatcttacaataatagtctgtagagtc

SEQ ID NO: 646 - DNA, 550 bp, Artificial
  Synthetic oligonucleotide
atggaaaaactgcaactcagaaatgtaaagtgagtcgaccaaggctaaagcggcaaaaccactatactttataacacagagtttggcactatttccactttgttctctctcaaagatgaaggctcaggaggagggaagataaaaacaaatcactggagagtcctggcatgctggaacatggactctagctagcaagaagggctcaaggaggtggccttctcctagacctcaactttgatgcaaaagctgttttgcagcctgaacaaagacaatccaatcctccagcaaatggcgtcattttccctacgtgtctagccttgagctacagaacaaaagaacaatcacatccgaagttgtagttcgcctggttgcggtggctcacgcctgtgatcccagcactttgggaggccaaggtgggtggatcacctgaggtcaggaggtcgagactagcctgaccaacatgaagaaaccccatctctactaaaaatacaaaattagctgggcgtggtggcacatgcctgtaatcccagctactcgggaggctgaggca

SEQ ID NO: 647 - DNA, 173 bp, Artificial
  Synthetic oligonucleotide
gtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaag

SEQ ID NO: 648 - DNA, 102 bp, Artificial
  Synthetic oligonucleotide
tccattgtgacactggatggagggaaacttgttcacctgcagaaatgggacgggcaagagaccacacttgtgcgggagctaattgatggaaaactcatcctg

SEQ ID NO: 649 - DNA, 33 bp, Artificial
  Synthetic oligonucleotide
ctcatatactcataaccttccccctaccctcag

SEQ ID NO: 650 - protein, 132 aa, Homo sapiens
VDAFLGTWKLVDSKNFDDYMKSLGVGFATRQVASMTKPTTIIEKNGDILTLKTHSTFKNTEISFKLGVEFDETTADDRKVKSIVTLDGGKLVHLQKWDGQETTLVRELIDGKLILTLTHGTAVCTRTYEKEA

SEQ ID NO: 651 - protein, 215 aa, Homo sapiens
MVDAFLGTWKLVDSKNFDDYMKSLGVGFATRQVASMTKPTTIIEKNGDILTLKTHSTFKNTEISFKLGVEFDETTADDRKVKSIVTLDGGKLVHLQKWDGQETTLVRELIDGKLILVRWATLELYLIGYYYCSFSQACSKKPSPPLRAVEAGTREWLWVRVVSGGNFLCSGFGLTQAGTQILPYRLHDCGQITFSKCNCKTGINNTNLVGLLGSL

SEQ ID NO: 652 - protein, 178 aa, Homo sapiens
MVDAFLGTWKLVDSKNFDDYMKSLGVGFATRQVASMTKPTTIIEKNGDILTLKTHSTFKNTEISFKLGVEFDETTADDRKVKSIVTLDGGKLVHLQKWDGQETTLVRELIDGKLILDVLTAWPSIYRRQVKVLREDEITILPWHLQWSREKATKLLRPTLPSYNNHGWEELRVGKSIV

SEQ ID NO: 653 - protein, 126 aa, Homo sapiens
MVDAFLGTWKLVDSKNFDDYMKSLGVGFATRQVASMTKPTTIIEKNGDILTLKTHSTFKNTEISFKLGVEFDETTADDRKVKSIVTLDGGKLVHLQKWDGQETTLVRELIDGKLILMEKLQLRNVK

SEQ ID NO: 654 - protein, 144 aa, Homo sapiens
MVDAFLGTWKLVDSKNFDDYMKSLAHILITFPLPSGVGFATRQVASMTKPTTIIEKNGDILTLKTHSTFKNTEISFKLGVEFDETTADDRKVKSIVTLDGGKLVHLQKWDGQETTLVRELIDGKLILTLTHGTAVCTRTYEKEA

SEQ ID NO: 655 - DNA, 1387 bp, Homo sapiens
accatagcaggccaggaaggaaggagaggatgcagagggagcagacagagggatggggggagggtcgaggcagtgactaatggaccatgtggcttcccctctcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgagtgggg

SEQ ID NO: 656 - DNA, 1414 bp, Homo sapiens
gtctcctggctcagggacctgagagacaggggttaaaaggacgttccagaagcatctggggacagaaccagcctcttccagggaggcctgggagctgggggggtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggaggcccggaggcctgcagcaggagcggccatgaagaagctgatggtggtgctgagtctgattgctgcaggaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgagtgggg

SEQ ID NO: 657 - DNA, 1402 bp, Homo sapiens
gtctcctggctcagggacctgagagacaggggttaaaaggacgttccagaagcatctggggacagaaccagcctcttccagggaggcctgggagctgggggggtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggaggcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtcagtagtgggaggctggtggggagcaggctactggctacttggggaagtgtgccaaaggatggggagtgggaaaattggtgaggggccatgggaagatgggctaatggtgaggaccaatgggacagggtttcaatgggagaaaggtcaagggggagggagagtgaatttgggagctgggccagtgagtgaacagccaatggaaaatgtagaccaatgggtgaatagcatgggagagatggaacataagatgaaggttcaataaagagggaaggtcagtggggagatgctaatcaggaaggatgtcaaaggtcaaaggggactgatcaggattcattgaacagcaggaaggaataatggagaaggaactgatggaagaagagaaaccaataaagcacaaaagccaactgaaggatgtgaattgagacagtgaatgggggtatagctgatggaagagggactaaggggaaaggatcaatggtccagaggagtcactagaggaaaaaacaggtccaatagatcagcaggatccatgaaggtgggcctgtgtgtgaagggccaataagaaaggtgaaccattggatgaagggccagtgggaaggcagagacaatgggggaggatgcggcaagttagaaaaggaccaatgagggaggtggacc

SEQ ID NO: 658 - DNA, 237 bp, Artificial
  Synthetic oligonucleotide
gtctcctggctcagggacctgagagacaggggttaaaaggacgttccagaagcatctggggacagaaccagcctcttccagggaggcctgggagctgggggggtgtgtctggcagtccctgcagccctgggctctgcggcccctgcgtcctccgcttggctctgccactgcatctgagtgtcttctctcctcacggctccccgcatttctaactctttctgcctcctcgtctcaaag

SEQ ID NO: 659 - DNA, 196 bp, Artificial
  Synthetic oligonucleotide
caggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatg

SEQ ID NO: 660 - DNA, 660 bp, Artificial
  Synthetic oligonucleotide
gtcagtagtgggaggctggtggggagcaggctactggctacttggggaagtgtgccaaaggatggggagtgggaaaattggtgaggggccatgggaagatgggctaatggtgaggaccaatgggacagggtttcaatgggagaaaggtcaagggggagggagagtgaatttgggagctgggccagtgagtgaacagccaatggaaaatgtagaccaatgggtgaatagcatgggagagatggaacataagatgaaggttcaataaagagggaaggtcagtggggagatgctaatcaggaaggatgtcaaaggtcaaaggggactgatcaggattcattgaacagcaggaaggaataatggagaaggaactgatggaagaagagaaaccaataaagcacaaaagccaactgaaggatgtgaattgagacagtgaatgggggtatagctgatggaagagggactaaggggaaaggatcaatggtccagaggagtcactagaggaaaaaacaggtccaatagatcagcaggatccatgaaggtgggcctgtgtgtgaagggccaataagaaaggtgaaccattggatgaagggccagtgggaaggcagagacaatgggggaggatgcggcaagttagaaaaggaccaatgagggaggtggacc

SEQ ID NO: 661 - DNA, 137 bp, Artificial
  Synthetic oligonucleotide
gtgatttccctgacaccatccagtgtgcatacatccacctggtgtcccgtgaggagtgtgagcatgcctaccctggccagatcacccagaacatgttgtgtgctggggatgagaagtacgggaaggattcctgccag

SEQ ID NO: 662 - DNA, 417 bp, Artificial
  Synthetic oligonucleotide
ggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcat

SEQ ID NO: 663 - DNA, 275 bp, Artificial
  Synthetic oligonucleotide
ctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgagtgggg

SEQ ID NO: 664 - DNA, 52 bp, Artificial
  Synthetic oligonucleotide
ctgttccttcccccgactcaagaatccccggaggcccggaggcctgcagcag

SEQ ID NO: 665 - DNA, 105 bp, Artificial
  Synthetic oligonucleotide
accatagcaggccaggaaggaaggagaggatgcagagggagcagacagagggatggggggagggtcgaggcagtgactaatggaccatgtggcttcccctctcag

SEQ ID NO: 666 - DNA, 48 bp, Artificial
  Synthetic oligonucleotide
gagcggccatgaagaagctgatggtggtgctgagtctgattgctgcag

SEQ ID NO: 667 - DNA, 54 bp, Artificial
  Synthetic oligonucleotide
cctgggcagaggagcagaataagttggtgcatggcggaccctgcgacaagacat

SEQ ID NO: 668 - DNA, 103 bp, Artificial
  Synthetic oligonucleotide
ctcacccctaccaagctgccctctacacctcgggccacttgctctgtggtggggtccttatccatccactgtgggtcctcacagctgcccactgcaaaaaacc

SEQ ID NO: 669 - DNA, 52 bp, Artificial
  Synthetic oligonucleotide
gaatcttcaggtcttcctggggaagcataaccttcggcaaagggagagttcc

SEQ ID NO: 670 - protein, 244 aa, Homo sapiens
MKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 671 - protein, 253 aa, Homo sapiens
MWLPLSGAAMKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 672 - protein, 150 aa, Homo sapiens
MKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGQ

SEQ ID NO: 673 - protein, 40 aa, Homo sapiens
MKKLMVVLSLIAAGIFRSSWGSITFGKGRVPRSRVLLSGL

SEQ ID NO: 674 - DNA, 3125 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccagggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 675 - DNA, 3263 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgagcctggacttgaaaggggagcagacaaatttcctgtcgttgggggaagttccctcttcttggccctggatctgaccctgaggcctcctgtagggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 676 - DNA, 3256 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcaggtgtgggcagcgacaggtcgcagggtggcaagggtgggcatgctctcactttgagaaggccctgactctggctcccacctcgcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 677 - DNA, 3164 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 678 - DNA, 2886 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 679 - DNA, 3100 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttgaaggtgtatgattttctctccacgttcatcacctcagggatgcgcttcctcctcaaccagcaggtgtgggcagcgacaggtcgcagggtggcaagggtgggcatgctctcactttgagaaggccctgactctggctcccacctcgcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 680 - DNA, 3254 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatggtaaggctggggtgtgaggatggaggaagaaaggaggggtgaactgggcgggcccagactgagcggggtgctcccacccacagagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 681 - DNA, 264 bp, Artificial
  Synthetic oligonucleotide
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctga

SEQ ID NO: 682 - DNA, 156 bp, Artificial
  Synthetic oligonucleotide
ctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaa

SEQ ID NO: 683 - DNA, 141 bp, Artificial
  Synthetic oligonucleotide
ctccccaaccgggcagtggagccccagctgcaggaggaagagcggatggtgtatgtggccttctctgagttcttcttcgactctgccatggagagctacttccgggcgggggccctgcagctgttgctggtgggggacaag

SEQ ID NO: 684 - DNA, 419 bp, Artificial
  Synthetic oligonucleotide
ctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcc

SEQ ID NO: 685 - DNA, 232 bp, Artificial
  Synthetic oligonucleotide
gttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcag

SEQ ID NO: 686 - DNA, 280 bp, Artificial
  Synthetic oligonucleotide
cttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 687 - DNA, 73 bp, Artificial
  Synthetic oligonucleotide
gcccgctcgccatggccctcttcggggccctcttcctagcgctgctggcaggcgcacatgcagagttcccagg

SEQ ID NO: 688 - DNA, 18 bp, Artificial
  Synthetic oligonucleotide
ctgcaagatccgcgtcac

SEQ ID NO: 689 - DNA, 20 bp, Artificial
  Synthetic oligonucleotide
ctccaaggcgctggagctgg

SEQ ID NO: 690 - DNA, 8 bp, Artificial
  Synthetic oligonucleotide
tgaagcag

SEQ ID NO: 691 - DNA, 6 bp, Artificial
  Synthetic oligonucleotide
gagggg

SEQ ID NO: 692 - DNA, 35 bp, Artificial
  Synthetic oligonucleotide
ctgcgctttctggagcaagagctggagactatcac

SEQ ID NO: 693 - DNA, 51 bp, Artificial
  Synthetic oligonucleotide
cattccggacctgcggggcaaagaaggccacttctactacaacatctctga

SEQ ID NO: 694 - DNA, 92 bp, Artificial
  Synthetic oligonucleotide
gcctggacttgaaaggggagcagacaaatttcctgtcgttgggggaagttccctcttcttggccctggatctgaccctgaggcctcctgtag

SEQ ID NO: 695 - DNA, 16 bp, Artificial
  Synthetic oligonucleotide
ggtgaaggtcacagag

SEQ ID NO: 696 - DNA, 89 bp, Artificial
  Synthetic oligonucleotide
ctgcaactgacatcttccgagctcgatttccagccacagcaggagctgatgcttcaaatcaccaatgcctccttggggctgcgcttccg

SEQ ID NO: 697 - DNA, 24 bp, Artificial
  Synthetic oligonucleotide
gagacagctgctctactggttctt

SEQ ID NO: 698 - DNA, 52 bp, Artificial
  Synthetic oligonucleotide
gaaggtgtatgattttctctccacgttcatcacctcagggatgcgcttcctc

SEQ ID NO: 699 - DNA, 12 bp, Artificial
  Synthetic oligonucleotide
ctcaaccagcag

SEQ ID NO: 700 - DNA, 85 bp, Artificial
  Synthetic oligonucleotide
gtgtgggcagcgacaggtcgcagggtggcaagggtgggcatgctctcactttgagaaggccctgactctggctcccacctcgcag

SEQ ID NO: 701 - DNA, 64 bp, Artificial
  Synthetic oligonucleotide
atctgccctgtcctctaccacgcagggacggtcctgctcaactccctcctggacaccgtgcctg

SEQ ID NO: 702 - DNA, 7 bp, Artificial
  Synthetic oligonucleotide
tgcgcag

SEQ ID NO: 703 - DNA, 85 bp, Artificial
  Synthetic oligonucleotide
ttctgtggacgagcttgttggcattgactattccctcatgaaggatcctgtggcttccaccagcaacctggacatggacttccgg

SEQ ID NO: 704 - DNA, 36 bp, Artificial
  Synthetic oligonucleotide
ggggccttcttccccctgactgagaggaactggagc

SEQ ID NO: 705 - DNA, 45 bp, Artificial
  Synthetic oligonucleotide
gtgccccacgacctggacatgctgctgagggccacctactttggg

SEQ ID NO: 706 - DNA, 15 bp, Artificial
  Synthetic oligonucleotide
agcattgtcctgctg

SEQ ID NO: 707 - DNA, 30 bp, Artificial
  Synthetic oligonucleotide
agcccagcagtgattgactccccattgaag

SEQ ID NO: 708 - DNA, 87 bp, Artificial
  Synthetic oligonucleotide
ctggagctgcgggtcctggccccaccgcgctgcaccatcaagccctctggcaccaccatctctgtcactgctagcgtcaccattgcc

SEQ ID NO: 709 - DNA, 30 bp, Artificial
  Synthetic oligonucleotide
ctggtcccaccagaccagcctgaggtccag

SEQ ID NO: 710 - DNA, 18 bp, Artificial
  Synthetic oligonucleotide
ctgtccagcatgactatg

SEQ ID NO: 711 - DNA, 27 bp, Artificial
  Synthetic oligonucleotide
gacgcccgtctcagcgccaagatggct

SEQ ID NO: 712 - DNA, 41 bp, Artificial
  Synthetic oligonucleotide
ctccgggggaaggccctgcgcacgcagctggacctgcgcag

SEQ ID NO: 713 - DNA, 43 bp, Artificial
  Synthetic oligonucleotide
gttccgaatctattccaaccattctgcactggagtcgctggct

SEQ ID NO: 714 - DNA, 15 bp, Artificial
  Synthetic oligonucleotide
ctgatcccattacag

SEQ ID NO: 715 - DNA, 49 bp, Artificial
  Synthetic oligonucleotide
gcccctctgaagaccatgctgcagattggggtgatgcccatgctcaatg

SEQ ID NO: 716 - DNA, 83 bp, Artificial
  Synthetic oligonucleotide
gtaaggctggggtgtgaggatggaggaagaaaggaggggtgaactgggcgggcccagactgagcggggtgctcccacccacag

SEQ ID NO: 717 - DNA, 41 bp, Artificial
  Synthetic oligonucleotide
agcggacctggcgtggggtgcagatcccactacctgagggc

SEQ ID NO: 718 - DNA, 36 bp, Artificial
  Synthetic oligonucleotide
atcaactttgtgcatgaggtggtgacgaaccatgcg

SEQ ID NO: 719 - DNA, 24 bp, Artificial
  Synthetic oligonucleotide
ggattcctcaccatcggggctgat

SEQ ID NO: 720 - DNA, 36 bp, Artificial
  Synthetic oligonucleotide
ctccactttgccaaagggctgcgagaggtgattgag

SEQ ID NO: 721 - DNA, 23 bp, Artificial
  Synthetic oligonucleotide
aagaaccggcctgctgatgtcag

SEQ ID NO: 722 - DNA, 9 bp, Artificial
  Synthetic oligonucleotide
ggcgtccac

SEQ ID NO: 723 - DNA, 23 bp, Artificial
  Synthetic oligonucleotide
tgcccccacaccgtccacagcag

SEQ ID NO: 724 - DNA, 24 bp, Artificial
  Synthetic oligonucleotide
ctgtctgagccctcaatccccaag

SEQ ID NO: 725 - DNA, 7 bp, Artificial
  Synthetic oligonucleotide
ctggcag

SEQ ID NO: 726 - DNA, 20 bp, Artificial
  Synthetic oligonucleotide
ctgtcattcaggaccccaac

SEQ ID NO: 727 - DNA, 90 bp, Artificial
  Synthetic oligonucleotide
ccctctcagcccctcttttcccacattcatagcctgtagtgccccctctaacccccagtgccacagagaagacgggatttgaagctgtac

SEQ ID NO: 728 - DNA, 22 bp, Artificial
  Synthetic oligonucleotide
ccaatttaattccataatcaat

SEQ ID NO: 729 - DNA, 12 bp, Artificial
  Synthetic oligonucleotide
ctgaggagcaat

SEQ ID NO: 730 - DNA, 13 bp, Artificial
  Synthetic oligonucleotide
gcccagtccctac

SEQ ID NO: 731 - DNA, 105 bp, Artificial
  Synthetic oligonucleotide
cttgatcgtgagaaaggcgatgtgggagaactccttcacgaagccggcaatctgctccccgctgtccccgtacttcactaaccagggccggcgctgcacctccat

SEQ ID NO: 732 - DNA, 108 bp, Artificial
  Synthetic oligonucleotide
ctgccccaccaggaaagacatcagcctacagcagctgcatccttgctcacagctaccagcaagaccttagggctgggaattcctccacacttgccctctgtgggccag

SEQ ID NO: 733 - DNA, 90 bp, Artificial
  Synthetic oligonucleotide
agccaggcagccagctggccactcccaggcatacccgctcccaatcctccacagcagcccctatcccagggccaggaatctctaccttac

SEQ ID NO: 734 - protein, 493 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 735 - protein, 398 aa, Homo sapiens
MALFGALFLALLAGAHAEFPGCKIRVTSKALELVKQEGLRFLEQELETITIPDLRGKEGHFYYNISEKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 736 - protein, 432 aa, Homo sapiens [sequence omitted]

SEQ ID NO: 737 - protein, 52 aa, Homo sapiens
MALFGALFLALLAGAHAEFPGRGCAFWSKSWRLSPFRTCGAKKATSTTTSLR

SEQ ID NO: 738 - protein, 98 aa, Homo sapiens
MALFGALFLALLAGAHAEFPGCKIRVTSKALELVKQEGLRFLEQELETITIPDLRGKEGHFYYNISEPGLERGADKFPVVGGSSLFLALDLTLRPPVG

SEQ ID NO: 739 - protein, 200 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQVWAATGRRVARVGMLSL

SEQ ID NO: 740 - protein, 217 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVLWTSLLALTIPS

SEQ ID NO: 741 - protein, 148 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFLKVYDFLSTFITSGMRFLLNQQVWAATGRRVARVGMLSL

SEQ ID NO: 742 - DNA, 2178 bp, Homo sapiens
gagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaaggtagggacggcgacagggcgggcaggctggagggaacaggcgccctgtcggggcacgcggctccttctttctccccagacttcacaggggaagaccagggccccgaggggacgctgtccctgccgggttcctggaaaaaccctgttcagttcccggcgctgcggccacactccctccgtgccgtttcgctttcgcatcccgcatctgagaggcgcagctgcctccacccgcctagtcccgcccaagggttcaatgagcgcctactgtgtacttttggggcaggagctggggtctccttttgtggcccagggcacaagttcagcagctggccaagggccgccggcatgcattcttgctgctacccttgatgcattcattccagccagggcagggctcgcgtgtctttgggacctattaggcagatgccctagaggctgagcgacttgctcaccgctccagcgacatgggccacccgccacccctcagctgaagccggaagtcagcacctattaggtgccgcctctattcagtcggacttggaaagggttcacgtggatcccttgctcagctcagaggcaaggtctccaggtgaagtgacaagaaatgagcatgggccaaggccggaggcggtggctcatgcctgtaatcccaacactttggaagtctgaggcaggcagatcacgaggtcaggagttcgagaccattctggcctacatggagaaaccctgtctctactaaaaatacaaaaattagctgggtgtggtggcatgtgcctataatcccagctactcaggaggctgaggcaggacaattgcttgaaccagggagtcgggtgttgcagtgagccgagatcgtgccgcagcacaccagcctagcgacagtgagactccatctcaaaaaaaaaaaaaaaagtctcaaagtcaagattccacctggcaagttctggaaggcgtgcaagatgaattgcgtatcacagccccctttctacaagactaccaagtggggttgagagaagtggggaactgcccagggctacacctgcctcccacgccttcctaatccacagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagccctta

SEQ ID NO: 743 - DNA, 1530 bp, Homo sapiens
gagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatggggtaagaatctttttagccctcagcttgacactcatagtcccatggagtcagggatggacaagacagagggaccagagataaaggaacccaggcggaggttgcagtgagctgagatcatgccactgcactccagcctgggcaacaagagcaaaacttgatagctttgcatagggaaagagggcattgatgctggggttttgaaaggtgagtaggagtccatcaggcaaaaaaagtatgtattaattcgaagtattaaacatccctagccacccccattgggaaagatgtgccactgatttgcgaggcgggaggcgggggccagacttgggaatatgtgcagccctttctgggctggaaccagggtgcatgggttggggtagctgctgggaatatgcgacccctgtcttgctttgtgcagaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagccctta

SEQ ID NO: 744 - DNA, 1084 bp, Homo sapiens
gagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgaaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagccctta

SEQ ID NO: 745 - DNA, 1019 bp, Homo sapiens
gagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggagtgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagccctta

SEQ ID NO: 746 - DNA, 761 bp, Homo sapiens
gagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagtgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagccctta

SEQ ID NO: 747 - DNA, 123 bp, Artificial
  Synthetic oligonucleotide
gagtggaggagggagagacgctggcccgggacccgaggggcgtgggcatcgggaggcgggcccgggttaggggcgggaccgccgcctggttaaaggcgcttatttcccaggcagccgctgcag

SEQ ID NO: 748 - DNA, 1066 bp, Artificial
  Synthetic oligonucleotide
gtagggacggcgacagggcgggcaggctggagggaacaggcgccctgtcggggcacgcggctccttctttctccccagacttcacaggggaagaccagggccccgaggggacgctgtccctgccgggttcctggaaaaaccctgttcagttcccggcgctgcggccacactccctccgtgccgtttcgctttcgcatcccgcatctgagaggcgcagctgcctccacccgcctagtcccgcccaagggttcaatgagcgcctactgtgtacttttggggcaggagctggggtctccttttgtggcccagggcacaagttcagcagctggccaagggccgccggcatgcattcttgctgctacccttgatgcattcattccagccagggcagggctcgcgtgtctttgggacctattaggcagatgccctagaggctgagcgacttgctcaccgctccagcgacatgggccacccgccacccctcagctgaagccggaagtcagcacctattaggtgccgcctctattcagtcggacttggaaagggttcacgtggatcccttgctcagctcagaggcaaggtctccaggtgaagtgacaagaaatgagcatgggccaaggccggaggcggtggctcatgcctgtaatcccaacactttggaagtctgaggcaggcagatcacgaggtcaggagttcgagaccattctggcctacatggagaaaccctgtctctactaaaaatacaaaaattagctgggtgtggtggcatgtgcctataatcccagctactcaggaggctgaggcaggacaattgcttgaaccagggagtcgggtgttgcagtgagccgagatcgtgccgcagcacaccagcctagcgacagtgagactccatctcaaaaaaaaaaaaaaaagtctcaaagtcaagattccacctggcaagttctggaaggcgtgcaagatgaattgcgtatcacagccccctttctacaagactaccaagtggggttgagagaagtggggaactgcccagggctacacctgcctcccacgccttcctaatccacag

SEQ ID NO: 749 - DNA, 418 bp, Artificial
  Synthetic oligonucleotide
gtaagaatctttttagccctcagcttgacactcatagtcccatggagtcagggatggacaagacagagggaccagagataaaggaacccaggcggaggttgcagtgagctgagatcatgccactgcactccagcctgggcaacaagagcaaaacttgatagctttgcatagggaaagagggcattgatgctggggttttgaaaggtgagtaggagtccatcaggcaaaaaaagtatgtattaattcgaagtattaaacatccctagccacccccattgggaaagatgtgccactgatttgcgaggcgggaggcgggggccagacttgggaatatgtgcagccctttctgggctggaaccagggtgcatgggttggggtagctgctgggaatatgcgacccctgtcttgctttgtgcag

SEQ ID NO: 750 - DNA, 293 bp, Artificial
  Synthetic oligonucleotide
aatcctgctccactaagaatggtgctaaagtaaaactagtttaataagcccttatggatggtgtaattaatttgataagtcagccattcccccttccccaggcctggcaaaacccgctctctactaaaaatacaaaaattagccaggcgcggtggcgggcgcctgtaatcccagctacttgggaggctgaggcaggagaattgcttgaacccggcaggcagaggttgcagtgagccgaaatcgcgccactgtgctccagcctgggcgacaagagcaaaattccatctcaaaat

SEQ ID NO: 751 - DNA, 31 bp, Artificial
  Synthetic oligonucleotide
tcgccacacctttgcccctgctgcgatgacc

SEQ ID NO: 752 - DNA, 18 bp, Artificial
  Synthetic oligonucleotide
ctgtcgccacttctgctg

SEQ ID NO: 753 - DNA, 51 bp, Artificial
  Synthetic oligonucleotide
ttcctgccaccgctgctgctgctgctggacgtccccacggcggcggtgcag

SEQ ID NO: 754 - DNA, 36 bp, Artificial
  Synthetic oligonucleotide
gcgtcccctctgcaagcgttagacttctttgggaat

SEQ ID NO: 755 - DNA, 21 bp, Artificial
  Synthetic oligonucleotide
gggccaccagttaactacaag

SEQ ID NO: 756 - DNA, 21 bp, Artificial
  Synthetic oligonucleotide
acaggcaatctatacctgcgg

SEQ ID NO: 757 - DNA, 36 bp, Artificial
  Synthetic oligonucleotide
gggcccctgaagaagtccaatgcaccgcttgtcaat

SEQ ID NO: 758 - DNA, 45 bp, Artificial
  Synthetic oligonucleotide
gtgaccctctactatgaagcactgtgcggtggctgccgagccttc

SEQ ID NO: 759 - DNA, 35 bp, Artificial
  Synthetic oligonucleotide
ctgatccgggagctcttcccaacatggctgttggt

SEQ ID NO: 760 - DNA, 46 bp, Artificial
  Synthetic oligonucleotide
catggagatcctcaatgtcacgctggtgccctacggaaacgcacag

SEQ ID NO: 761 - DNA, 39 bp, Artificial
  Synthetic oligonucleotide
gaacaaaatgtcagtggcaggtgggagttcaagtgccag

SEQ ID NO: 762 - DNA, 36 bp, Artificial
  Synthetic oligonucleotide
catggagaagaggagtgcaaattcaacaaggtggag

SEQ ID NO: 763 - DNA, 39 bp, Artificial
  Synthetic oligonucleotide
gcctgcgtgttggatgaacttgacatggagctagccttc

SEQ ID NO: 764 - DNA, 54 bp, Artificial
  Synthetic oligonucleotide
ctgaccattgtctgcatggaagagtttgaggacatggagagaagtctgccacta

SEQ ID NO: 765 - DNA, 22 bp, Artificial
  Synthetic oligonucleotide
tgcctgcagctctacgccccag

SEQ ID NO: 766 - DNA, 64 bp, Artificial
  Synthetic oligonucleotide
ggctgtcgccagacactatcatggagtgtgcaatgggggaccgcggcatgcagctcatgcacgc

SEQ ID NO: 767 - DNA, 39 bp, Artificial
  Synthetic oligonucleotide
caacgcccagcggacagatgctctccagccaccacacga

SEQ ID NO: 768 - DNA, 28 bp, Artificial
  Synthetic oligonucleotide
gtatgtgccctgggtcaccgtcaatggg

SEQ ID NO: 769 - DNA, 4 bp, Artificial
  Synthetic oligonucleotide
aaac

SEQ ID NO: 770 - DNA, 20 bp, Artificial
  Synthetic oligonucleotide
ccttggaagatcagacccag

SEQ ID NO: 771 - DNA, 30 bp, Artificial
  Synthetic oligonucleotide
ctccttacccttgtctgccagttgtaccag

SEQ ID NO: 772 - DNA, 22 bp, Artificial
  Synthetic oligonucleotide
ggcaagaagccggatgtctgcc

SEQ ID NO: 773 - DNA, 4 bp, Artificial
  Synthetic oligonucleotide
cttc

SEQ ID NO: 774 - DNA, 9 bp, Artificial
  Synthetic oligonucleotide
ctcaaccag

SEQ ID NO: 775 - DNA, 100 bp, Artificial
  Synthetic oligonucleotide
ctccctcaggagtgtttgcttcaagtgatggccggtgagctgcggagagctcatggaaggcgagtgggaacccggctgcctgcctttttttctgatccag

SEQ ID NO: 776 - DNA, 85 bp, Artificial
  Synthetic oligonucleotide
accctcggcacctgctacttaccaactggaaaattttatgcatcccatgaagcccagatacacaaaattccaccccatgatcaag

SEQ ID NO: 777 - protein, 261 aa, Homo sapiens [sequence omitted]

SEQ ID NO: 778 - protein, 189 aa, Homo sapiens [sequence omitted]

SEQ ID NO: 779 - protein, 238 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHEYVPWVTVNGVRIFLALSLTLIVPWSQGWTRQRDQR

SEQ ID NO: 780 - protein, 244 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHENPWKIRPSSLPLSASCTRARSRMSALPQPAPSGVFASSDGR

SEQ ID NO: 781 - protein, 219 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVECLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 782 - protein, 133 aa, Homo sapiens
MTLSPLLLFLPPLLLLLDVPTAAVQASPLQALDFFGNGPPVNYKCLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 783 - DNA, 6807 bp, Homo sapiens
ccctaatgcctccaacaataactgttgactttttattttcagtcagagaagcctggcaaccaagaactgttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaaggaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaaggtggcacctccatgtaagagaagcccaagacaaccccaaataatataatttcaaataggcagtgtcttttctgtgcttccaaggggaaggaggaaccttaccgataattgtttgtgaaagatccagggaagaaacaaaatttaaatgcactgctccccaacccctgcaataaccctccccatgtgtaggtacacacacacacacacacacacacacttaaaatggagaaaaatgaacagtttttttggtaagattcctgcactgtggctgcaggctttggtctttcctgggtctttcgagttgaggattgttgtaattagaaatggtaaattcaaagggaggaaattatgtaaagaaaaccaatctatgtctttcctccctaaaatggggaaaaagggaacatacaaatgaagaaaatataaatgtaaatatatttgaagatttaaaaagccctgaaaggttaacctttagtgcaaatggaaagttttaatttctgctcctgggtcttacacaaacaacttacatcatgaaaaactatttccattaatgccctttttattagagcagtcactgataacactagaatatcaaagactctaacagacaagccactaaatttaacgccaataacttgaacaaagtgaagagagccaaatatgagaaagaaaactttagtctttaaataacacttgcaaccatgtggttacatgtggttgcatgtaaaccacacaaaaggatggtcttgctcaaaaaaataatggtgagtaagtaacatggaggcatttggggaattcatgtgtgcaaatgcctggcatgcagagtatggcactacagggtaaccctacacacacagccacagagaagattcctcctgtgtaacaaccgtgaaagaagagggagattactgcttggttaagaaaggcgagatagtttttaaagctatagtaaaaattacagaacaaatagcaaatatgaagtaaaaatcaacactagataaaaaattaaagagaaatttgacttttgcaaagagaaaaggtattgcatgagactgaaagcagcagactgaataaaaaaagatagtttgaactatctttggcccataaaatcagtggccatgtttatcagtctgaatcatctttaaataagtccaataaagctttgagcaagtttacattaattatgagtcttagaaaagcctgcttagctttaaatttcttacaggcagggactatatattctgtatttctagctaagtacccaaatccaatacaatagtttgcttactgaatgtataacaacatattaattcaatgaagagaaacttttgaaacttttttgacataatttcagattcccatatacctttcacccagattccccaaatattaatgatgtgcgtagccacattggctttctcattcttttccctatctccctctcatgctcaccctctatatgtacacacacagacgtgtatagatacacatacaactatctttcctaaaaacaagaatattcttgtacatgaccacaatacaatgatcgaaattagaaaagcaacaatgatttaaaaactagagatcttcaaatttcgctaataatcctaatcatgttctttacagaaaaagaaaatcccggatcatgtactgcattgttgccatgtcttttaagtctcctttactctgaataattccttaatacagggcactttgtagaatgtccttcaatttgagtttgtctaatgtttccttatgattagatttaggttatgcacttttggcaagactatcatggcatgatgttgtgtttttcttagtacaccatatcaggaggcacaagatattgatcagttctattactggttatgttaacttcaagctttggttaagatggtgtctgccaggtgtctccattgtaaagttattcattttccctttacaattaataaagatcttgtagggaagaaagtaatctttctttaaataaagcagcaatagaatgagagatttttaaacatataaaaagcagaaaaatataaatgaatcaggagtaaagtaacattaaaaattggaatacatttaaagaaccatctactaatttctaaccatatattatttttaataatggtcttaaaatttctttttctatagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 784 - DNA, 4596 bp, Homo sapiens
ccctaatgcctccaacaataactgttgactttttattttcagtcagagaagcctggcaaccaagaactgttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaaggaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 785 - DNA, 4444 bp, Homo sapiens
ccctaatgcctccaacaataactgttgactttttattttcagtcagagaagcctggcaaccaagaactgttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaaggaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 786 - DNA, 4013 bp, Homo sapiens
ccctaatgcctccaacaataactgttgactttttattttcagtcagagaagcctggcaaccaagaactgttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaaggaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaaggtgaatatccagcatcttctgagactcacaggagaatatggaatgtgatctacccaatcacagtcagtgtgattattttattccaaatatctaccaaggaatgaccaggagaataagatcctccgatgttcgcaatggtgtggtgtcaggaggctgcctcttagacaatctccagatgtactgtgatgtgagtttgaaaaagagttcctgaagtaccacatctgggagacatgccactagctgagcttcccaaaagtctaccaagagctgaggaattgtatcttcatccttagcacaaagcaccttaaaaacagtaaaaggagcctctatattccagataaatatagcactgataaagcgacagctgggctgaatatcacagcatcacatgggccacgcaatcaataatttaccattagcattagcgccatggcaaaagcaaatttagacatttttaaaaggaaacagattctaggatgtacaaataaagtttctacagatatagtcttttaattagtacttttatcttataaactgattatgtatgtctgttttttcaataaacaaacaaatgaaaaactca

SEQ ID NO: 787 - DNA, 4061 bp, Homo sapiens
ccctaatgcctccaacaataactgttgactttttattttcagtcagagaagcctggcaaccaagaactgttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaaggaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaagtaattctccagactctgattcccaatttcaagcagtaattttaggtttccttttcagagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtactcacgggggcgggggtgggggtggtgcattttaacaggctgtacagcctttccacagattactctcatcatagagagtctggaccaagaaagtgaaaagggaggtagttgtgaagaggggatgcaaggaggtgtctgtgtgtatgcaagtacatgcacatgcttgtactaaaaaaaaaagtccacaggagagcttaagagaaaaacctgaaggtagtagacatctatgaatcctcaagcgtgaatcagagagatgctgtctcctcgctcagctagaacacagctcaaatggcatctaccacaccatatgtggctggatgttcccatgcctgtctctagcacatgtggttctaagggccagaggctgccacttggaactctaaattccccctatctagtacagtatctggcatatattaggagatcatcaaatgtttctttaataaacatagagtaaaatcttgaacagattatatacataggtgagcattttctttaataagaaccatatttttcttctattagttgtaaagttggcttccaggaaaatactatttctcaataacttagcagggtgtagcaagggtgctattttaggtagagaggtcaggagggcttccttgaggaggtggcattgctgaaaacacctaaagtttgagaagtaatgaaattcaggtaattgtgcacgaattgattctaggccccgaagacaggagcaatgcctggtgtgtgtgagcagcagcaaggcagccagaggctaaagaaaagcacacaagggacagaatgctagagatgagatccagggagagcaggggccagatggagtagggaggacctcagactcgagatttaagactgatgttctgatggacaccttttaaggggctgttggtgatgtgtggttaagtgaccctaagggggcaaggacagaatctggggtcagttaaggaccactgcaataatctgggtaaaatcatcatcatcatcatcatcatcgagatttggaatatggtggaagcggctgaagtggtgagatgttatcatattctggttccattttaaaggtggtactaaaaggacctgctggaaaatgggcactagggagtgttagggaagagaggagtcaagcatgaccccaaggttttgggcactgaccactggtggaagagcaggttgtaaaggggtgtggaaaa

SEQ ID NO: 788 - DNA, 3838 bp, Homo sapiens
ccctaatgcctccaacaataactgttgactttttattttcagtcagagaagcctggcaaccaagaactgttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaaggaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcatcttctgagactcacaggagaatatggaatgtgatctacccaatcacagtcagtgtgattattttattccaaatatctaccaaggaatgaccaggagaataagatcctccgatgttcgcaatggtgtggtgtcaggaggctgcctcttagacaatctccagatgtactgtgatgtgagtttgaaaaagagttcctgaagtaccacatctgggagacatgccactagctgagcttcccaaaagtctaccaagagctgaggaattgtatcttcatccttagcacaaagcaccttaaaaacagtaaaaggagcctctatattccagataaatatagcactgataaagcgacagctgggctgaatatcacagcatcacatgggccacgcaatcaataatttaccattagcattagcgccatggcaaaagcaaatttagacatttttaaaaggaaacagattctaggatgtacaaataaagtttctacagatatagtcttttaattagtacttttatcttataaactgattatgtatgtctgttttttcaataaacaaacaaatgaaaaactca

SEQ ID NO: 789 - DNA, 3568 bp, Homo sapiens
ccctaatgcctccaacaataactgttgactttttattttcagtcagagaagcctggcaaccaagaactgttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaaggaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcata

SEQ ID NO: 790 - DNA, 4270 bp, Homo sapiens
ccctaatgcctccaacaataactgttgactttttattttcagtcagagaagcctggcaaccaagaactgttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaaggaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgaggctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 791 - DNA, 4022 bp, Homo sapiens
ccctaatgcctccaacaataactgttgactttttattttcagtcagagaagcctggcaaccaagaactgttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaaggaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 792 - DNA, 2246 bp, Homo sapiens
ccctaatgcctccaacaataactgttgactttttattttcagtcagagaagcctggcaaccaagaactgttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaaggaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactgtaagtactgcatcatccaccaatctaccaagttattttagtactgcatatgtaatgcttttaactaaacaaaatgtgaagagctttgctcattgattattttttcaataaacgattacaatagtgtcctgaa

SEQ ID NO: 793 - DNA, 1634 bp, Homo sapiens
ccctaatgcctccaacaataactgttgactttttattttcagtcagagaagcctggcaaccaagaactgttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaaggaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaaggtacatcttctccttattgcacatgctatatgaccaaaagacaggggcagggcagtttgtcttttaaaaagaaatcaagtcttctgtgctgagattgagcaggtaaggtagagaggtggtaagtagaaaaaaaggaagggaagagccaggcaggactaggagaagaagggataaatagaacaagcattcctacggggaaaatgccaatgaaggtaatgtgaaagaaatatattctctcagggttcagtttgctgtatctaacttccaacagtggtgctgaagagacatatgactttaccaaatgtgactaccaaaagggcactccacggtgatagatctgtagttactcatactatattggtaaacataatatcatagtatttatttctaacatcatgaaaaagacaacggagctcaagagcctgaaatacaattctaacttgaacaatcgttacctgtaaagacttgtctctgtttgtggctatatgcaccagaaaatagacgcacaactttgaattccaatcttcccatttgccaaaaagcatttaatagttatgtggtcagtggacatccagacacaggagtgtcttccaagcaccagatactgatcataaaaattccctgagtgtttctgtctgtaaaacaggagtgactggtccagacttgtgatttattcgaaaaaataaatactaacatttttaaaaactataaatcacctgaaaacataaatcaaaatacatgctaaaagtttagtcttgctaaaatagtaactttaact

SEQ ID NO: 794 - DNA, 3636 bp, Homo sapiens
ccctaatgcctccaacaataactgttgactttttattttcagtcagagaagcctggcaaccaagaactgttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaaggaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaaggtggcacctccatgtaagagaagcccaagacaaccccaaataatataatttcaaataggcagtgtcttttctgtgcttccaaggggaaggaggaaccttaccgataattgtttgtgaaagatccagggaagaaacaaaatttaaatgcactgctccccaacccctgcaataaccctccccatgtgtaggtacacacacacacacac

SEQ ID NO: 795 - DNA, 395 bp, Artificial
  Synthetic oligonucleotide
ccctaatgcctccaacaataactgttgactttttattttcagtcagagaagcctggcaaccaagaactgttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaaggaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacac

SEQ ID NO: 796 - DNA, 192 bp, Artificial
  Synthetic oligonucleotide
ggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgc

SEQ ID NO: 797 - DNA, 187 bp, Artificial
  Synthetic oligonucleotide
gggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcat

SEQ ID NO: 798 - DNA, 778 bp, Artificial
  Synthetic oligonucleotide
gtacatcttctccttattgcacatgctatatgaccaaaagacaggggcagggcagtttgtcttttaaaaagaaatcaagtcttctgtgctgagattgagcaggtaaggtagagaggtggtaagtagaaaaaaaggaagggaagagccaggcaggactaggagaagaagggataaatagaacaagcattcctacggggaaaatgccaatgaaggtaatgtgaaagaaatatattctctcagggttcagtttgctgtatctaacttccaacagtggtgctgaagagacatatgactttaccaaatgtgactaccaaaagggcactccacggtgatagatctgtagttactcatactatattggtaaacataatatcatagtatttatttctaacatcatgaaaaagacaacggagctcaagagcctgaaatacaattctaacttgaacaatcgttacctgtaaagacttgtctctgtttgtggctatatgcaccagaaaatagacgcacaactttgaattccaatcttcccatttgccaaaaagcatttaatagttatgtggtcagtggacatccagacacaggagtgtcttccaagcaccagatactgatcataaaaattccctgagtgtttctgtctgtaaaacaggagtgactggtccagacttgtgatttattcgaaaaaataaatactaacatttttaaaaactataaatcacctgaaaacataaatcaaaatacatgctaaaagtttagtcttgctaaaatagtaactttaact

SEQ ID NO: 799 - DNA, 174 bp, Artificial
  Synthetic oligonucleotide
attctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtatt

SEQ ID NO: 800 - DNA, 148 bp, Artificial
  Synthetic oligonucleotide
agtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccag

SEQ ID NO: 801 - DNA, 140 bp, Artificial
  Synthetic oligonucleotide
tgactcagcggtgttttttgaacaaggtaccacaagaattggaggctcttataaaaagctggtttatcgtgagtacacagatgcctccttcacaaatcgaaaggagagaggccctgaagaagagcatcttggcatcctgg

SEQ ID NO: 802 - DNA, 153 bp, Artificial
  Synthetic oligonucleotide
gtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaa

SEQ ID NO: 803 - DNA, 212 bp, Artificial
  Synthetic oligonucleotide
gtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacag

SEQ ID NO: 804 - DNA, 151 bp, Artificial
  Synthetic oligonucleotide
aaagatgtagacaaggaattctatttgtttcctacagtatttgatgagaatgagagtttactcctggaagataatattagaatgtttacaactgcacctgatcaggtggataaggaagatgaagactttcaggaatctaataaaatgcact

SEQ ID NO: 805 - DNA, 133 bp, Artificial
  Synthetic oligonucleotide
gtaagtactgcatcatccaccaatctaccaagttattttagtactgcatatgtaatgcttttaactaaacaaaatgtgaagagctttgctcattgattattttttcaataaacgattacaatagtgtcctgaa

SEQ ID NO: 806 - DNA, 213 bp, Artificial
  Synthetic oligonucleotide
ccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagagg

SEQ ID NO: 807 - DNA, 1196 bp, Artificial
  Synthetic oligonucleotide
gtactcacgggggcgggggtgggggtggtgcattttaacaggctgtacagcctttccacagattactctcatcatagagagtctggaccaagaaagtgaaaagggaggtagttgtgaagaggggatgcaaggaggtgtctgtgtgtatgcaagtacatgcacatgcttgtactaaaaaaaaaagtccacaggagagcttaagagaaaaacctgaaggtagtagacatctatgaatcctcaagcgtgaatcagagagatgctgtctcctcgctcagctagaacacagctcaaatggcatctaccacaccatatgtggctggatgttcccatgcctgtctctagcacatgtggttctaagggccagaggctgccacttggaactctaaattccccctatctagtacagtatctggcatatattaggagatcatcaaatgtttctttaataaacatagagtaaaatcttgaacagattatatacataggtgagcattttctttaataagaaccatatttttcttctattagttgtaaagttggcttccaggaaaatactatttctcaataacttagcagggtgtagcaagggtgctattttaggtagagaggtcaggagggcttccttgaggaggtggcattgctgaaaacacctaaagtttgagaagtaatgaaattcaggtaattgtgcacgaattgattctaggccccgaagacaggagcaatgcctggtgtgtgtgagcagcagcaaggcagccagaggctaaagaaaagcacacaagggacagaatgctagagatgagatccagggagagcaggggccagatggagtagggaggacctcagactcgagatttaagactgatgttctgatggacaccttttaaggggctgttggtgatgtgtggttaagtgaccctaagggggcaaggacagaatctggggtcagttaaggaccactgcaataatctgggtaaaatcatcatcatcatcatcatcatcgagatttggaatatggtggaagcggctgaagtggtgagatgttatcatattctggttccattttaaaggtggtactaaaaggacctgctggaaaatgggcactagggagtgttagggaagagaggagtcaagcatgaccccaaggttttgggcactgaccactggtggaagagcaggttgtaaaggggtgtggaaaa

SEQ ID NO: 808 - DNA, 217 bp, Artificial
  Synthetic oligonucleotide
gacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatg

SEQ ID NO: 809 - DNA, 206 bp, Artificial
  Synthetic oligonucleotide
gtggcacctccatgtaagagaagcccaagacaaccccaaataatataatttcaaataggcagtgtcttttctgtgcttccaaggggaaggaggaaccttaccgataattgtttgtgaaagatccagggaagaaacaaaatttaaatgcactgctccccaacccctgcaataaccctccccatgtgtaggtacacacacacacacac

SEQ ID NO: 810 - DNA, 1944 bp, Artificial
  Synthetic oligonucleotide
acacacacacttaaaatggagaaaaatgaacagtttttttggtaagattcctgcactgtggctgcaggctttggtctttcctgggtctttcgagttgaggattgttgtaattagaaatggtaaattcaaagggaggaaattatgtaaagaaaaccaatctatgtctttcctccctaaaatggggaaaaagggaacatacaaatgaagaaaatataaatgtaaatatatttgaagatttaaaaagccctgaaaggttaacctttagtgcaaatggaaagttttaatttctgctcctgggtcttacacaaacaacttacatcatgaaaaactatttccattaatgccctttttattagagcagtcactgataacactagaatatcaaagactctaacagacaagccactaaatttaacgccaataacttgaacaaagtgaagagagccaaatatgagaaagaaaactttagtctttaaataacacttgcaaccatgtggttacatgtggttgcatgtaaaccacacaaaaggatggtcttgctcaaaaaaataatggtgagtaagtaacatggaggcatttggggaattcatgtgtgcaaatgcctggcatgcagagtatggcactacagggtaaccctacacacacagccacagagaagattcctcctgtgtaacaaccgtgaaagaagagggagattactgcttggttaagaaaggcgagatagtttttaaagctatagtaaaaattacagaacaaatagcaaatatgaagtaaaaatcaacactagataaaaaattaaagagaaatttgacttttgcaaagagaaaaggtattgcatgagactgaaagcagcagactgaataaaaaaagatagtttgaactatctttggcccataaaatcagtggccatgtttatcagtctgaatcatctttaaataagtccaataaagctttgagcaagtttacattaattatgagtcttagaaaagcctgcttagctttaaatttcttacaggcagggactatatattctgtatttctagctaagtacccaaatccaatacaatagtttgcttactgaatgtataacaacatattaattcaatgaagagaaacttttgaaacttttttgacataatttcagattcccatatacctttcacccagattccccaaatattaatgatgtgcgtagccacattggctttctcattcttttccctatctccctctcatgctcaccctctatatgtacacacacagacgtgtatagatacacatacaactatctttcctaaaaacaagaatattcttgtacatgaccacaatacaatgatcgaaattagaaaagcaacaatgatttaaaaactagagatcttcaaatttcgctaataatcctaatcatgttctttacagaaaaagaaaatcccggatcatgtactgcattgttgccatgtcttttaagtctcctttactctgaataattccttaatacagggcactttgtagaatgtccttcaatttgagtttgtctaatgtttccttatgattagatttaggttatgcacttttggcaagactatcatggcatgatgttgtgtttttcttagtacaccatatcaggaggcacaagatattgatcagttctattactggttatgttaacttcaagctttggttaagatggtgtctgccaggtgtctccattgtaaagttattcattttccctttacaattaataaagatcttgtagggaagaaagtaatctttctttaaataaagcagcaatagaatgagagatttttaaacatataaaaagcagaaaaatataaatgaatcaggagtaaagtaacattaaaaattggaatacatttaaagaaccatctactaatttctaaccatatattatttttaataatggtcttaaaatttctttttctatag

SEQ ID NO: 811 - DNA, 302 bp, Artificial
  Synthetic oligonucleotide
acaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcat

SEQ ID NO: 812 - DNA, 280 bp, Artificial
  Synthetic oligonucleotide
tattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagctt

SEQ ID NO: 813 - DNA, 225 bp, Artificial
  Synthetic oligonucleotide
tgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaa

SEQ ID NO: 814 - DNA, 537 bp, Artificial
  Synthetic oligonucleotide
tcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccaccttaaaaaatgtatggcttctttgaggaattcttatgtcttaaagactttttacattctagacaattaaattgattgaggtcataaattaagaagtgaatagttaccactacacggtaaggtaagcagcctgaaagcatttgtatcatatatgtgtgtgtgtgtgtgtgtgtgtgtgtgtgtgtgtgtgatatataaaataaaaaactcctctacttgtactttggcattcaatttttagaaattcagtctcaaatgccattatggtatttttcaaatgata

SEQ ID NO: 815 - DNA, 466 bp, Artificial
  Synthetic oligonucleotide
atcctccgatgttcgcaatggtgtggtgtcaggaggctgcctcttagacaatctccagatgtactgtgatgtgagtttgaaaaagagttcctgaagtaccacatctgggagacatgccactagctgagcttcccaaaagtctaccaagagctgaggaattgtatcttcatccttagcacaaagcaccttaaaaacagtaaaaggagcctctatattccagataaatatagcactgataaagcgacagctgggctgaatatcacagcatcacatgggccacgcaatcaataatttaccattagcattagcgccatggcaaaagcaaatttagacatttttaaaaggaaacagattctaggatgtacaaataaagtttctacagatatagtcttttaattagtacttttatcttataaactgattatgtatgtctgttttttcaataaacaaacaaatgaaaaactca

SEQ ID NO: 816 - DNA, 56 bp, Artificial
  Synthetic oligonucleotide
ctctaggccctacacctttcattcacatggaataacttactataaggaacatgagg

SEQ ID NO: 817 - DNA, 26 bp, Artificial
  Synthetic oligonucleotide
cggacctttaataatctgtaaaaaag

SEQ ID NO: 818 - DNA, 58 bp, Artificial
  Synthetic oligonucleotide
ctgtgaatggatacacttttggaagtctcccaggactctccatgtgtgctgaagacag

SEQ ID NO: 819 - DNA, 36 bp, Artificial
  Synthetic oligonucleotide
aaccctggagaatggatgctcagctgtcagaatcta

SEQ ID NO: 820 - DNA, 13 bp, Artificial
  Synthetic oligonucleotide
aaccatctgaaag

SEQ ID NO: 821 - DNA, 23 bp, Artificial
  Synthetic oligonucleotide
ccggtttgcaagcctttttccag

SEQ ID NO: 822 - DNA, 66 bp, Artificial
  Synthetic oligonucleotide
gtccaggagtgtaacaagtcttcatcaaaggataatatccgtgggaagcatgttagacactactac

SEQ ID NO: 823 - DNA, 83 bp, Artificial
  Synthetic oligonucleotide
attgccgctgaggaaatcatctggaactatgctccctctggtatagacatcttcactaaagaaaacttaacagcacctggaag

SEQ ID NO: 824 - DNA, 42 bp, Artificial
  Synthetic oligonucleotide
ggacttttaatgttgaatgccttacaactgatcattacacag

SEQ ID NO: 825 - DNA, 74 bp, Artificial
  Synthetic oligonucleotide
gcggcatgaagcaaaaatatactgtgaaccaatgcaggcggcagtctgaggattccaccttctacctgggagag

SEQ ID NO: 826 - DNA, 63 bp, Artificial
  Synthetic oligonucleotide
aggacatactatatcgcagcagtggaggtggaatgggattattccccacaaagggagtgggaa

SEQ ID NO: 827 - DNA, 29 bp, Artificial
  Synthetic oligonucleotide
aaggagctgcatcatttacaagagcagaa

SEQ ID NO: 828 - DNA, 62 bp, Artificial
  Synthetic oligonucleotide
gtaattctccagactctgattcccaatttcaagcagtaattttaggtttccttttcagagaa

SEQ ID NO: 829 - DNA, 25 bp, Artificial
  Synthetic oligonucleotide
tgtttcaaatgcatttttagataag

SEQ ID NO: 830 - DNA, 115 bp, Artificial
  Synthetic oligonucleotide
ggagagttttacataggctcaaagtacaagaaagttgtgtatcggcagtatactgatagcacattccgtgttccagtggagagaaaagctgaagaagaacatctgggaattctag

SEQ ID NO: 831 - DNA, 57 bp, Artificial
  Synthetic oligonucleotide
gtccacaacttcatgcagatgttggagacaaagtcaaaattatctttaaaaacatgg

SEQ ID NO: 832 - DNA, 72 bp, Artificial
  Synthetic oligonucleotide
ccacaaggccctactcaatacatgcccatggggtacaaacagagagttctacagttactccaacattaccag

SEQ ID NO: 833 - DNA, 77 bp, Artificial
  Synthetic oligonucleotide
gtgaaactctcacttacgtatggaaaatcccagaaagatctggagctggaacagaggattctgcttgtattccatgg

SEQ ID NO: 834 - DNA, 30 bp, Artificial
  Synthetic oligonucleotide
gcttattattcaactgtggatcaagttaag

SEQ ID NO: 835 - DNA, 107 bp, Artificial
  Synthetic oligonucleotide
ctattaatggaagaatgtttggaaacctacaaggcctcacaatgcacgtgggagatgaagtcaactggtatctgatgggaatgggcaatgaaatagacttacacact

SEQ ID NO: 836 - DNA, 33 bp, Artificial
  Synthetic oligonucleotide
gtacattttcacggccatagcttccaatacaag

SEQ ID NO: 837 - DNA, 5 bp, Artificial
  Synthetic oligonucleotide
cacag

SEQ ID NO: 838 - DNA, 56 bp, Artificial
  Synthetic oligonucleotide
gggagtttatagttctgatgtctttgacattttccctggaacataccaaaccctag

SEQ ID NO: 839 - DNA, 102 bp, Artificial
  Synthetic oligonucleotide
aaatgtttccaagaacacctggaatttggttactccactgccatgtgaccgaccacattcatgctggaatggaaaccacttacaccgttctacaaaatgaag

SEQ ID NO: 840 - DNA, 12 bp, Artificial
  Synthetic oligonucleotide
gtgaatatccag

SEQ ID NO: 841 - DNA, 53 bp, Artificial
  Synthetic oligonucleotide
ttaaaaaaagatctatgaccagatattctcctgggtgctcctcaaaggaacac

SEQ ID NO: 842 - DNA, 54 bp, Artificial
  Synthetic oligonucleotide
caaaatagacctgtggcagatgtcacatgagtagaatttctgcccagccttaac

SEQ ID NO: 843 - DNA, 54 bp, Artificial
  Synthetic oligonucleotide
gttagctttgtaaacttctacttcatttgattcagagaaacagagcatgagttt

SEQ ID NO: 844 - DNA, 105 bp, Artificial
  Synthetic oligonucleotide
catcttctgagactcacaggagaatatggaatgtgatctacccaatcacagtcagtgtgattattttattccaaatatctaccaaggaatgaccaggagaataag

SEQ ID NO: 845 - protein, 1065 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 846 - protein, 1065 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEGGTSM

SEQ ID NO: 847 - protein, 1021 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKKCFQEHLEFGYSTAM

SEQ ID NO: 848 - protein, 994 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHWTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 849 - protein, 1094 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEGEYPASSETHRRIWNVIYPITVSVIILFQISTKE

SEQ ID NO: 850 - protein, 762 aa, Homo sapiens [sequence omitted]

SEQ ID NO: 851 - protein, 1017 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHLLRLTGEYGM

SEQ ID NO: 852 - protein, 1009 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKGSL

SEQ ID NO: 853 - protein, 936 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEAVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 854 - protein, 819 aa, Homo sapiens
MPLTMGKRNLFLLTPVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 855 - protein, 634 aa, Homo sapiens [sequence omitted]

SEQ ID NO: 856 - protein, 232 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKGTSSPYCTCYMTKRQGQGSLSFKKKSSLLC

SEQ ID NO: 857 - DNA, 8816 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaaccaaagccacagttgggcacgctaatctttagcaatattactccaaaaagcttcaacatgtcatggaccactcaagctgggctttttgcaaagattgttatcaatgtgagtgacgctcactcactgcatgagtcccagcaattcacagtctcaggagatgcaaagcaagctcacatcacaggcttggtggagaacactggctatgacgtcagtgtggcaggaaccaccttggctggggatcccaccagacccctcactgcctttgtcattacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaacccag

SEQ ID NO: 858 - DNA, 13023 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaaccaaagccacagttgggcacgctaatctttagcaatattactccaaaaagcttcaacatgtcatggaccactcaagctgggctttttgcaaagattgttatcaatgtgagtgacgctcactcactgcatgagtcccagcaattcacagtctcaggagatgcaaagcaagctcacatcacaggcttggtggagaacactggctatgacgtcagtgtggcaggaaccaccttggctggggatcccaccagacccctcactgcctttgtcattacaggtactcaatcagaggttctcacttgtctaacacagagagaaaaggagataagtcatcttaaaggaaaattcaacaaaaatacaatcttcactgcaaatgtgtactctcttatttttaattgacaaatagtaattgtatatatttatggagaatagtgtgttgttttgatatacatatacattgtggattgattgaatcaacctaattaacatatcaatcacctcaccttatttatttatttatttatttatttatttatttattgtgctgtgagaacatttaaaatctactcttttaggaattttgaagtattcaatatgttattattaactatggccagtcaccatgctgtgcagtagatcactaaaacttattccttctgtctaactgaactttgtactccttgaccaacatctcccctttcttcatctccccaaccccagtcaccggtaaccaccagtcttctctgtgcttctatgtgttcagctttcttagattacacaaatgagatcacgcagtatttgtctttctgtgcctcgattatttcactctgtacaatgtcttctgggttcatccgtgttgttgaaaatgacagaattttcctcttttttaaggctataaagtattccattatatatatatgtgtatatatatatatatgtatatatacacacatatggaatgtatatatttatatataaatatgatctatctatacaccacattttctttatccattcatccattgacagacacaggttacaatacattactcatgatagccaagataatatatgtaaacttctaagtaaagagaaagcagatactattataaaggagaggactttcacagctgctcttaggaagtggagagaacgttctcaagagttgtataaagcttttagggttttttgtgcccagttttattggctgttttatccctagtttagagattctgcctaaaaagtgactcctaagttagtaaaggcctaagatcgaaatcctgttcataaatcatgctaggtaacgcagttcatatatgtgacaaaagtataaccatctttttctttaaaaaataattattcttaaaactgacaacacagatgcagctagatgcagctaatttgaaattcctgtctcctttttttcttttgattaaaaaaaaaatgcatttaccagtactgtcagaaaaaaaaaaaaaagaaaaaaaagaaaaaagaaaaatcacctagaaaagagacgctgaaccttctccactaatcctccttatccctcaggattgccatcactgattggggttggctttgggtatggaaagaacgtagaacttggagtcggaagacctggttgtatatctcagcttaggcacctagcagatgtatgacctaggataagtcattaacttctctggtttttttagatgtgatcggggttggaagattgatgaaggttcaacctcagatggcagataaatttcaagtttaattaagccctacccattcactcaacttgacttcttgaacatttgccaatgttcaatttggcaaatgctgccaaatggtggcagcaaaaacttcaatggcaaaggctgcacatggtgtcagtttactaaattctagcccaaaaagcctcagaaaatatttagaagtctcttccttttcattagtgataattttcagaagacggactttgccatctgattttcacattaaaccaggtctctcccagggtctaaattgccatcactaagacatgtcaattagtacaattaaatatttaattataggcagcatggtgtcctggaagagtgaggattttgagatcaagcttttgtggtttctaaacctctcccacagctttttagctacataattttagcaagttcttaacttgtttgaaccctaatttccttatgcatggagagaggataccacaggcacttctgggagccttgtctcatagattaaatagagttggtgaaatttaactgcctagcatccagtaggaattttatacatgctaggttctttctgctgtctcccaacattattaggaaagtggctttcttaaaaataaccaataaggctagatagaacaatagacctatgcaatcatgaactccctctcgtttttaagagaactttggatgtgttttaatgtaagattaaaaaatgagtattttttcctatccagttacctaatgtgaattaaatcattcagatgagtcttcaaatgcagaacatggtaatttcttaagggactgagacaaggaggaacgagatgagattctcactcctcaggaggggagaaatggccacagatcccatcaggccattgcttgtagcggcttgcaggacctcccacataacagaagaaaaggaagctgagagacccagtcttgggaatcctagatccagttacagcattgtctcagctaatccatgatgtgaaaagattgcgttttaaaagaagcatattaaaaaagaaaaaaacaaaacaggagggactcttaaataacaagcccttgattgcctaattagcctgaatgccctcactttcattggaattcactgctttgatggtgtggaggtgcaaagaggccagctatcaaagagagacgccacttatctaaacaaaatccaggaacagaattcgagacccttgtctctcagatgaagattgtttgcccagtataagagatttcatcctcgcttttgatagaattatgattcttgggaaatctttacgtggaaaaaactgcctcagaataaacaccaagtgtttcaaaataactacaggaagtccaagccacagcaaaatttaaatctctatttacaaaatgaaggtattcattcccttattcattcagtcaccaaacacttctttttaaaacatttttctttatgtctcatggattagaccctaggcattagtgaattaatgcaagagcatttatctctttgtaagtttccatttagctgtaatggaaaagaagtgtctaaactagatgcagctaatttgaaattcctgtctcctttttttcttctgattaaaaaaaaaatgcatttaccagtactgtcagaaaaaaaaaaagaaaaaagaaaaaacacctagaaaagagacgctgaaccttctccactaatcctccttatccctcaggattgccatcactgattggggttggctttgggtatggaaagaacatagaacttggagtcggaggacctgattgtatctcagcttaggcacctagcagatgtatgacctaggataagtcattaacctctctggtttttttagatgtgatcggggttggaaggcaggtagcaatatctaccttactgtatcattttgaagactaactaggataacaatgtgaagccttgtcagttggcaagtatcaatggaaacttagccaacataagctcactccttttggatatcccaatgtgtgaaaaggccctttagcacctgagaaatcagaatgcctgggacatacatgtttggtgaacgaatgaaggagagatggtgacagaatttactaagacccagatgtgttcttgttttctaactttatccaggaaaataaacagcaaaagatttagcaaatcttatcatttcttagtgggttataaccatgagctattaattttgacacaaaaaaaaacttacctcctccctttatttcagcttgtgaggatatgtcactaattgacttcattaatttgattcaaactgtgcactagaagtgggatagaaacacatgaagtataccggaaagaaattatactcgaaaaaaaaaaaaagagctgaaggcagtgggaagtagacaacgggatccaaactcaacaaaatgcaacctatttgtataaagaactacatggcctttggagtcaaacctgactaaaatcttcgctctatctcttcttacaagcttgtaactttagctaagtcaatcaacttctttgaaactcagtttgctcacgtgtgaaattagaataatacctacctcatgggctattaagagaattgcacaagataacactatctggcacccaataagttcttactgaattttcattttctaagcatataacacaaattgaatgatggacttgggtatctattggtgttcttggaaacgtgtgctatcctgacagagtcagtgctgctaacctgagttattttcactcctcccttctttcagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaacccag

SEQ ID NO: 859 - DNA, 10117 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacaggtatttcaaatcaagtgagccatttgttcctcttcctggtccccttctgtgtaatctgtctaccggatcgccatgactttaacatctttgttcacattccctacttaatccataaatgtagtctactgtttcaccttctccccacactccctcttgtcatatgtacttaatgaacactccccactcccaccccagaaatgagaaggtcgaaatatttctgctttgtattcaaaatcctttagaccttgtcttgtccatagctcttgtgtgcttacctcatatcatcgtcccttgtgatcaacctggctggtccccagctacatttcagccttctcaaaagaaatataccaatgagtatatttccaaaacgtatttaaaacctttgccatctcaaaatctcaaccatgatcttaacaaacttacccagtgggctcgtcattggaaaaccaaatgtgaacttattttatcggtaatcactaatatcagagagactctgcaacacggactaaatccataattttctcaagactaatgattcctacagaaattaacaacggaatagtcaaacatctgtgtttcccaaagtctttctagagattactagctccacagaatgttcaaaggtcctactcggtgaggaaattccacgttcaaataagtttggaaagactgagttaaacaaagttaaagaggatctttaactgcacggcttttcagaacaccctaacgtgcatcatctccaagaagtacttatccaggcagtattttccaaacttatttgacaaaggatactttttaaggaagaggatcaaacaggaatagttcactgtgagcacactttgggaaactcagctctaaatctacattgacattgagttttgtctagttaaggcaatgcaagatgaaaccctgggtccacagtatgtagcacaaaaggttccaacctcagttctaccatctgaacatttatctaatagttaataaaataacaagaaagaatgcaaaaaaaaaaaaaaaaagtcaagggtaggagccttctttagtgaaacagcactaagaacaaagcaaaaagaccataacattttaaaagccattttgggcaggctcaaggagaatgtaatcagcagtatcatcatgagcagctctacagatcattaatgctggtttatttgtcttttcaaaaagaaaagaaaaaggtcttgcaggggatgggcactcagccactggaagacagagagcaaatgtaaacaatttactggctttgaacttatttaataatatgtgggacgggccaatgctgagtccagatgtggatttactgaattgcttttagacaaaactcacatatgcaaacatatgcttgacttgtattgaatgtgtctactccatctttcccctctcctgactctactggacttgttaatgttgaatgattttatttttggtatctcaggacacttctatctctgaaagccggggcatcactacatattgatacccctactggagagaagattgcacggactggtaaatgatgttgtctttcctccttctcccaccattttctctccctctagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaacccag

SEQ ID NO: 860 - DNA, 8267 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaacccag

SEQ ID NO: 861 - DNA, 8267 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaacccag

SEQ ID NO: 862 - DNA, 7721 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaacccag

SEQ ID NO: 863 - DNA, 7448 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaacccag

SEQ ID NO: 864 - DNA, 9337 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgagtaccaccagggactgcagagccctcaggcctaggggaagagggagagggcaaagcaggggaggagaagagggtgatctcctcctgatgcactctgacacccccatgtgtgaggccttgcaagatagtgcctgtcacacagaggcactcaggaattctctcttaaacaaaagaatgggaaacacgctggctactttttgaaacggggagataagtttcttgtagtttatctcatccaatcctcatcaaacaactctgtgatgtataaatgacagttgatcattgaacccattgcttacattaattagcactgactaagcatttattatctaccaggcactgtgctaagagtttaagatgaattattccgaccccattaccataggagctgggtagtgtatttttgaattaataaactctatttttttagaacagttttaggttcatggcacaattaagtgaacagaagttttcatatacaccccacacccacccacacaacctccccattatcaatatcctgcaccagaatggtgcatttgttacaatcaatgaacctacattgacacatcattatcacccaaaactgggtggtatttttaatccctgtttttcaggtgagaacaccaagacttaaggaggggcaggtgaccacccaaagttacatagcaaattagggatggacagaatggagcctgatgctctctccacagtgccacactccttcctctcacaacgatgccctctttcctgcaatagcttaagtacacccagattcatcgatatgtttataggtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaacccag

SEQ ID NO: 865 - DNA, 6902 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaacccag

SEQ ID NO: 866 - DNA, 6629 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaacccag

SEQ ID NO: 867 - DNA, 8281 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaacccag

SEQ ID NO: 868 - DNA, 6843 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttggtaatgcagccctgcatgtttatatctaaaatgcctgattctgccctccttgtcacttttcctaacccacagggacctatgggagagaaagagatgaggaagaagaactacttctggtggcagacacagaatgtcaaattcttaatgaaaaagactatcatttaaatgctctgaatcatcaaaatgtaaaccaaaaagtatctgagacagatctcaatcaatttagaggtttacttagccaacgttaaggacacgcccagaaaaaaagaacacaaagccacaggaacagcctgtggtccatgccttttttttttttttttttttcca

SEQ ID NO: 869 - DNA, 6320 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacaggtactgtaaataaacaggagagaacagagaaaagtcatgactcaggggtcttcttctcacagggctgagtaatcacaggagctttggatgcaggcaggctggcgctctgatcctgactctttcaattacagactgtgttaccttggacaatttggctaagtccttatgcaaaaaaagtatgatgccatttacttaatagggttgtgaggattaaatgagataattcatataaagcccatagcggaaggcctggcaggtagcaagggcccagcaaatgagagctattcacgttgccattaatgcatcatcatcgttacaattatcatctttttttttttacgttccaaagattcttccttctatctattatctcatcatatctcatctcatcatatcatatctcatcattttatccagagatacacttccttgttctttggccaaatgttcgagctataccaagtagggagataatggagaagcagcacgtctatctatacacattaatatttataaaatgctacatgtgaataatcagtacggtgatcagcaaggataaaggagagaggtggcaagattaacatgctactgtttatgaagctctctaactttgatactcataacaactctgaaaggcacctagagtgtccttggagtttaattacctttttccataggagctgtttcaaggagaaaaaaaaaaaagatggttaataatatgactcttaggcccagagtgatggctcacacctgtaatcccagcatttcaggaggctgagacaggaggatcacttgagtccaggagtttgagaccagcctaggcaacatagtaagaccctacctgtgca

SEQ ID NO: 870 - DNA, 4446 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacaggtatatgaccctcctcccagactggagacatgataggagccagcatgtcattgaaatagagaaaat

SEQ ID NO: 871 - DNA, 4463 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacaggtattctagacgaattcactaattcacttcctcccctttgtctctgctcgggaggaatcaaagcactttcttgctttaaactgggatcagctcctaccacattggggaaataccagtgaatcatctctgcttcttcctaaatgtcacatcccttatttggctaagtcctagttgtagcccagttccatggaaaattccacctactcctcctttaaaaaagtgagaggtggcttttctttcaaagtaagtttcagtcacaatatctaaaaagttggaaagcccaacctgtaaatgaagaaaaaatagctctgagctcatgagctcattttaagaacaccaaaggactccccatagcc

SEQ ID NO: 872 - DNA, 3762 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactggtgagtctgccctgagcttcctccaaactctaggttgattctgaggttagcagatctcctcagccagggtgtcctcacatgagaaagccaaatgcaaaagcaagccactttctccatctctgaagcccctgaacaccactttgaaagggctgcttactcgtcttttctacctcctgtcaactgatacagcaaatttccccc

SEQ ID NO: 873 - DNA, 3335 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtgagctctgcatctctgcaagcctgagccagccagccctagagggcccttaaaggatgggcacctgctcccacatgtccccatttgcaaccctcagaaataagtccaatttcctgaaatactgctta

SEQ ID NO: 874 - DNA, 2817 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgtgagtatcacctttaatacttatagaatgataaggctgattgtacctcgtaacactcctgattaa

SEQ ID NO: 875 - DNA, 3027 bp, Homo sapiens
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtgtgagtgagcagaactcttttgggcagcctcacctgatgtcagcccacccagcgtataaccctccctcgccacggcccctacaatcctatagttgttctttacagttataccaaataagagcctagaattaagtccatagaatcacttattaaagaaatccctcattttccatcaaatctttctccttgctctcctatatacttcctgccagagaaaatcattacaagtaacatttagcaagtgtttactgtgtatcagactttgttgtaagcagtctacatattagtataagagtcctcatttggccgggcatggtggctcatgcccgtaatcctagcactttgggaggccaaagtaggtggatcacctggggtcacgagttcaagaccagcctggccagcatggcgaaaccctgtctctactaaaaatacaaaaattagtcgggcctggtggtgcatgcctgtaatcccggctactcaggaggctgaggcagagaatagcttgaaaccaggaggcagagtttgtagtgagctgagatcatgccactg

SEQ ID NO: 876 - DNA, 211 bp, Artificial
  Synthetic oligonucleotide
gctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaag

SEQ ID NO: 877 - DNA, 593 bp, Artificial
  Synthetic oligonucleotide
aaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacag

SEQ ID NO: 878 - DNA, 868 bp, Artificial
  Synthetic oligonucleotide
gccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatga

SEQ ID NO: 879 - DNA, 253 bp, Artificial
  Synthetic oligonucleotide
ctgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgac

SEQ ID NO: 880 - DNA, 264 bp, Artificial
  Synthetic oligonucleotide
tgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgt

SEQ ID NO: 881 - DNA, 549 bp, Artificial
  Synthetic oligonucleotide
gtgagtgagcagaactcttttgggcagcctcacctgatgtcagcccacccagcgtataaccctccctcgccacggcccctacaatcctatagttgttctttacagttataccaaataagagcctagaattaagtccatagaatcacttattaaagaaatccctcattttccatcaaatctttctccttgctctcctatatacttcctgccagagaaaatcattacaagtaacatttagcaagtgtttactgtgtatcagactttgttgtaagcagtctacatattagtataagagtcctcatttggccgggcatggtggctcatgcccgtaatcctagcactttgggaggccaaagtaggtggatcacctggggtcacgagttcaagaccagcctggccagcatggcgaaaccctgtctctactaaaaatacaaaaattagtcgggcctggtggtgcatgcctgtaatcccggctactcaggaggctgaggcagagaatagcttgaaaccaggaggcagagtttgtagtgagctgagatcatgccactg

SEQ ID NO: 882 - DNA, 157 bp, Artificial
  Synthetic oligonucleotide
aataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacac

SEQ ID NO: 883 - DNA, 270 bp, Artificial
  Synthetic oligonucleotide
gcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacag

SEQ ID NO: 884 - DNA, 128 bp, Artificial
  Synthetic oligonucleotide
gtgagctctgcatctctgcaagcctgagccagccagccctagagggcccttaaaggatgggcacctgctcccacatgtccccatttgcaaccctcagaaataagtccaatttcctgaaatactgctta

SEQ ID NO: 885 - DNA, 264 bp, Artificial
  Synthetic oligonucleotide
agttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactg

SEQ ID NO: 886 - DNA, 201 bp, Artificial
  Synthetic oligonucleotide
gtgagtctgccctgagcttcctccaaactctaggttgattctgaggttagcagatctcctcagccagggtgtcctcacatgagaaagccaaatgcaaaagcaagccactttctccatctctgaagcccctgaacaccactttgaaagggctgcttactcgtcttttctacctcctgtcaactgatacagcaaatttccccc

SEQ ID NO: 887 - DNA, 273 bp, Artificial
  Synthetic oligonucleotide
aacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacag

SEQ ID NO: 888 - DNA, 273 bp, Artificial
  Synthetic oligonucleotide
gggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacag

SEQ ID NO: 889 - DNA, 356 bp, Artificial
  Synthetic oligonucleotide
gtattctagacgaattcactaattcacttcctcccctttgtctctgctcgggaggaatcaaagcactttcttgctttaaactgggatcagctcctaccacattggggaaataccagtgaatcatctctgcttcttcctaaatgtcacatcccttatttggctaagtcctagttgtagcccagttccatggaaaattccacctactcctcctttaaaaaagtgagaggtggcttttctttcaaagtaagtttcagtcacaatatctaaaaagttggaaagcccaacctgtaaatgaagaaaaaatagctctgagctcatgagctcattttaagaacaccaaaggactccccatagcc

SEQ ID NO: 890 - DNA, 273 bp, Artificial
  Synthetic oligonucleotide
aggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacag

SEQ ID NO: 891 - DNA, 273 bp, Artificial
  Synthetic oligonucleotide
aggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacag

SEQ ID NO: 892 - DNA, 273 bp, Artificial
  Synthetic oligonucleotide
ccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacag

SEQ ID NO: 893 - DNA, 276 bp, Artificial
  Synthetic oligonucleotide
aaccaaagccacagttgggcacgctaatctttagcaatattactccaaaaagcttcaacatgtcatggaccactcaagctgggctttttgcaaagattgttatcaatgtgagtgacgctcactcactgcatgagtcccagcaattcacagtctcaggagatgcaaagcaagctcacatcacaggcttggtggagaacactggctatgacgtcagtgtggcaggaaccaccttggctggggatcccaccagacccctcactgcctttgtcattacag

SEQ ID NO: 894 - DNA, 4207 bp, Artificial
  Synthetic oligonucleotide
gtactcaatcagaggttctcacttgtctaacacagagagaaaaggagataagtcatcttaaaggaaaattcaacaaaaatacaatcttcactgcaaatgtgtactctcttatttttaattgacaaatagtaattgtatatatttatggagaatagtgtgttgttttgatatacatatacattgtggattgattgaatcaacctaattaacatatcaatcacctcaccttatttatttatttatttatttatttatttatttattgtgctgtgagaacatttaaaatctactcttttaggaattttgaagtattcaatatgttattattaactatggccagtcaccatgctgtgcagtagatcactaaaacttattccttctgtctaactgaactttgtactccttgaccaacatctcccctttcttcatctccccaaccccagtcaccggtaaccaccagtcttctctgtgcttctatgtgttcagctttcttagattacacaaatgagatcacgcagtatttgtctttctgtgcctcgattatttcactctgtacaatgtcttctgggttcatccgtgttgttgaaaatgacagaattttcctcttttttaaggctataaagtattccattatatatatatgtgtatatatatatatatgtatatatacacacatatggaatgtatatatttatatataaatatgatctatctatacaccacattttctttatccattcatccattgacagacacaggttacaatacattactcatgatagccaagataatatatgtaaacttctaagtaaagagaaagcagatactattataaaggagaggactttcacagctgctcttaggaagtggagagaacgttctcaagagttgtataaagcttttagggttttttgtgcccagttttattggctgttttatccctagtttagagattctgcctaaaaagtgactcctaagttagtaaaggcctaagatcgaaatcctgttcataaatcatgctaggtaacgcagttcatatatgtgacaaaagtataaccatctttttctttaaaaaataattattcttaaaactgacaacacagatgcagctagatgcagctaatttgaaattcctgtctcctttttttcttttgattaaaaaaaaaatgcatttaccagtactgtcagaaaaaaaaaaaaaagaaaaaaaagaaaaaagaaaaatcacctagaaaagagacgctgaaccttctccactaatcctccttatccctcaggattgccatcactgattggggttggctttgggtatggaaagaacgtagaacttggagtcggaagacctggttgtatatctcagcttaggcacctagcagatgtatgacctaggataagtcattaacttctctggtttttttagatgtgatcggggttggaagattgatgaaggttcaacctcagatggcagataaatttcaagtttaattaagccctacccattcactcaacttgacttcttgaacatttgccaatgttcaatttggcaaatgctgccaaatggtggcagcaaaaacttcaatggcaaaggctgcacatggtgtcagtttactaaattctagcccaaaaagcctcagaaaatatttagaagtctcttccttttcattagtgataattttcagaagacggactttgccatctgattttcacattaaaccaggtctctcccagggtctaaattgccatcactaagacatgtcaattagtacaattaaatatttaattataggcagcatggtgtcctggaagagtgaggattttgagatcaagcttttgtggtttctaaacctctcccacagctttttagctacataattttagcaagttcttaacttgtttgaaccctaatttccttatgcatggagagaggataccacaggcacttctgggagccttgtctcatagattaaatagagttggtgaaatttaactgcctagcatccagtaggaattttatacatgctaggttctttctgctgtctcccaacattattaggaaagtggctttcttaaaaataaccaataaggctagatagaacaatagacctatgcaatcatgaactccctctcgtttttaagagaactttggatgtgttttaatgtaagattaaaaaatgagtattttttcctatccagttacctaatgtgaattaaatcattcagatgagtcttcaaatgcagaacatggtaatttcttaagggactgagacaaggaggaacgagatgagattctcactcctcaggaggggagaaatggccacagatcccatcaggccattgcttgtagcggcttgcaggacctcccacataacagaagaaaaggaagctgagagacccagtcttgggaatcctagatccagttacagcattgtctcagctaatccatgatgtgaaaagattgcgttttaaaagaagcatattaaaaaagaaaaaaacaaaacaggagggactcttaaataacaagcccttgattgcctaattagcctgaatgccctcactttcattggaattcactgctttgatggtgtggaggtgcaaagaggccagctatcaaagagagacgccacttatctaaacaaaatccaggaacagaattcgagacccttgtctctcagatgaagattgtttgcccagtataagagatttcatcctcgcttttgatagaattatgattcttgggaaatctttacgtggaaaaaactgcctcagaataaacaccaagtgtttcaaaataactacaggaagtccaagccacagcaaaatttaaatctctatttacaaaatgaaggtattcattcccttattcattcagtcaccaaacacttctttttaaaacatttttctttatgtctcatggattagaccctaggcattagtgaattaatgcaagagcatttatctctttgtaagtttccatttagctgtaatggaaaagaagtgtctaaactagatgcagctaatttgaaattcctgtctcctttttttcttctgattaaaaaaaaaatgcatttaccagtactgtcagaaaaaaaaaaagaaaaaagaaaaaacacctagaaaagagacgctgaaccttctccactaatcctccttatccctcaggattgccatcactgattggggttggctttgggtatggaaagaacatagaacttggagtcggaggacctgattgtatctcagcttaggcacctagcagatgtatgacctaggataagtcattaacctctctggtttttttagatgtgatcggggttggaaggcaggtagcaatatctaccttactgtatcattttgaagactaactaggataacaatgtgaagccttgtcagttggcaagtatcaatggaaacttagccaacataagctcactccttttggatatcccaatgtgtgaaaaggccctttagcacctgagaaatcagaatgcctgggacatacatgtttggtgaacgaatgaaggagagatggtgacagaatttactaagacccagatgtgttcttgttttctaactttatccaggaaaataaacagcaaaagatttagcaaatcttatcatttcttagtgggttataaccatgagctattaattttgacacaaaaaaaaacttacctcctccctttatttcagcttgtgaggatatgtcactaattgacttcattaatttgattcaaactgtgcactagaagtgggatagaaacacatgaagtataccggaaagaaattatactcgaaaaaaaaaaaaagagctgaaggcagtgggaagtagacaacgggatccaaactcaacaaaatgcaacctatttgtataaagaactacatggcctttggagtcaaacctgactaaaatcttcgctctatctcttcttacaagcttgtaactttagctaagtcaatcaacttctttgaaactcagtttgctcacgtgtgaaattagaataatacctacctcatgggctattaagagaattgcacaagataacactatctggcacccaataagttcttactgaattttcattttctaagcatataacacaaattgaatgatggacttgggtatctattggtgttcttggaaacgtgtgctatcctgacagagtcagtgctgctaacctgagttattttcactcctcccttctttcag

SEQ ID NO: 895 - DNA, 273 bp, Artificial
  Synthetic oligonucleotide
aggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacag

SEQ ID NO: 896 - DNA, 1577 bp, Artificial
  Synthetic oligonucleotide
gtatttcaaatcaagtgagccatttgttcctcttcctggtccccttctgtgtaatctgtctaccggatcgccatgactttaacatctttgttcacattccctacttaatccataaatgtagtctactgtttcaccttctccccacactccctcttgtcatatgtacttaatgaacactccccactcccaccccagaaatgagaaggtcgaaatatttctgctttgtattcaaaatcctttagaccttgtcttgtccatagctcttgtgtgcttacctcatatcatcgtcccttgtgatcaacctggctggtccccagctacatttcagccttctcaaaagaaatataccaatgagtatatttccaaaacgtatttaaaacctttgccatctcaaaatctcaaccatgatcttaacaaacttacccagtgggctcgtcattggaaaaccaaatgtgaacttattttatcggtaatcactaatatcagagagactctgcaacacggactaaatccataattttctcaagactaatgattcctacagaaattaacaacggaatagtcaaacatctgtgtttcccaaagtctttctagagattactagctccacagaatgttcaaaggtcctactcggtgaggaaattccacgttcaaataagtttggaaagactgagttaaacaaagttaaagaggatctttaactgcacggcttttcagaacaccctaacgtgcatcatctccaagaagtacttatccaggcagtattttccaaacttatttgacaaaggatactttttaaggaagaggatcaaacaggaatagttcactgtgagcacactttgggaaactcagctctaaatctacattgacattgagttttgtctagttaaggcaatgcaagatgaaaccctgggtccacagtatgtagcacaaaaggttccaacctcagttctaccatctgaacatttatctaatagttaataaaataacaagaaagaatgcaaaaaaaaaaaaaaaaagtcaagggtaggagccttctttagtgaaacagcactaagaacaaagcaaaaagaccataacattttaaaagccattttgggcaggctcaaggagaatgtaatcagcagtatcatcatgagcagctctacagatcattaatgctggtttatttgtcttttcaaaaagaaaagaaaaaggtcttgcaggggatgggcactcagccactggaagacagagagcaaatgtaaacaatttactggctttgaacttatttaataatatgtgggacgggccaatgctgagtccagatgtggatttactgaattgcttttagacaaaactcacatatgcaaacatatgcttgacttgtattgaatgtgtctactccatctttcccctctcctgactctactggacttgttaatgttgaatgattttatttttggtatctcaggacacttctatctctgaaagccggggcatcactacatattgatacccctactggagagaagattgcacggactggtaaatgatgttgtctttcctccttctcccaccattttctctccctctag

SEQ ID NO: 897 - DNA, 273 bp, Artificial
  Synthetic oligonucleotide
aagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacag

SEQ ID NO: 898 - DNA, 848 bp, Artificial
  Synthetic oligonucleotide
gtactgtaaataaacaggagagaacagagaaaagtcatgactcaggggtcttcttctcacagggctgagtaatcacaggagctttggatgcaggcaggctggcgctctgatcctgactctttcaattacagactgtgttaccttggacaatttggctaagtccttatgcaaaaaaagtatgatgccatttacttaatagggttgtgaggattaaatgagataattcatataaagcccatagcggaaggcctggcaggtagcaagggcccagcaaatgagagctattcacgttgccattaatgcatcatcatcgttacaattatcatctttttttttttacgttccaaagattcttccttctatctattatctcatcatatctcatctcatcatatcatatctcatcattttatccagagatacacttccttgttctttggccaaatgttcgagctataccaagtagggagataatggagaagcagcacgtctatctatacacattaatatttataaaatgctacatgtgaataatcagtacggtgatcagcaaggataaaggagagaggtggcaagattaacatgctactgtttatgaagctctctaactttgatactcataacaactctgaaaggcacctagagtgtccttggagtttaattacctttttccataggagctgtttcaaggagaaaaaaaaaaaagatggttaataatatgactcttaggcccagagtgatggctcacacctgtaatcccagcatttcaggaggctgagacaggaggatcacttgagtccaggagtttgagaccagcctaggcaacatagtaagaccctacctgtgca

SEQ ID NO: 899 - DNA, 123 bp, Artificial
  Synthetic oligonucleotide
ccatgggctccccaaaggaagtcattttctcagacatcactgaaaattcggctactgtcagctggagggcacccacagcccaagtggagagcttccggattacctatgtgcccattacaggag

SEQ ID NO: 900 - DNA, 144 bp, Artificial
  Synthetic oligonucleotide
gtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacag

SEQ ID NO: 901 - DNA, 126 bp, Artificial
  Synthetic oligonucleotide
tgccagaaattacacgcacggtgtccgggaacacagtggagtatgctctgaccgacctcgagcctgccacggaatacacactgagaatctttgcagagaaagggccccagaagagctcaaccatca

SEQ ID NO: 902 - DNA, 133 bp, Artificial
  Synthetic oligonucleotide
gaagtcattgtgggtccagataccacctcctacagcctggcagacctgagcccatccacccactacacagccaagatccaggcactcaatgggcccctgaggagcaatatgatccagaccatcttcaccacaa

SEQ ID NO: 903 - DNA, 797 bp, Artificial
  Synthetic oligonucleotide
gtgagtaccaccagggactgcagagccctcaggcctaggggaagagggagagggcaaagcaggggaggagaagagggtgatctcctcctgatgcactctgacacccccatgtgtgaggccttgcaagatagtgcctgtcacacagaggcactcaggaattctctcttaaacaaaagaatgggaaacacgctggctactttttgaaacggggagataagtttcttgtagtttatctcatccaatcctcatcaaacaactctgtgatgtataaatgacagttgatcattgaacccattgcttacattaattagcactgactaagcatttattatctaccaggcactgtgctaagagtttaagatgaattattccgaccccattaccataggagctgggtagtgtatttttgaattaataaactctatttttttagaacagttttaggttcatggcacaattaagtgaacagaagttttcatatacaccccacacccacccacacaacctccccattatcaatatcctgcaccagaatggtgcatttgttacaatcaatgaacctacattgacacatcattatcacccaaaactgggtggtatttttaatccctgtttttcaggtgagaacaccaagacttaaggaggggcaggtgaccacccaaagttacatagcaaattagggatggacagaatggagcctgatgctctctccacagtgccacactccttcctctcacaacgatgccctctttcctgcaatagcttaagtacacccagattcatcgatatgtttatag

SEQ ID NO: 904 - DNA, 327 bp, Artificial
  Synthetic oligonucleotide
gtaatgcagccctgcatgtttatatctaaaatgcctgattctgccctccttgtcacttttcctaacccacagggacctatgggagagaaagagatgaggaagaagaactacttctggtggcagacacagaatgtcaaattcttaatgaaaaagactatcatttaaatgctctgaatcatcaaaatgtaaaccaaaaagtatctgagacagatctcaatcaatttagaggtttacttagccaacgttaaggacacgcccagaaaaaaagaacacaaagccacaggaacagcctgtggtccatgccttttttttttttttttttttcca

SEQ ID NO: 905 - DNA, 162 bp, Artificial
  Synthetic oligonucleotide
ggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcag

SEQ ID NO: 906 - DNA, 164 bp, Artificial
  Synthetic oligonucleotide
gtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcag

SEQ ID NO: 907 - DNA, 122 bp, Artificial
  Synthetic oligonucleotide
ggcgttaactggttccactggaagggccacgaacactcaatccagtttgctgagatgaagctgagaccaagcaacttcagaaatcttgaaggcaggcgcaaacgggcataaattccagggac

SEQ ID NO: 908 - DNA, 1258 bp, Artificial
  Synthetic oligonucleotide
tttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaacccag

SEQ ID NO: 909 - DNA, 115 bp, Artificial
  Synthetic oligonucleotide
tgtgcagaactctcctgtccaaatgactgccatggccggggtcgctgtgtgaatgggcagtgcgtgtgccatgaaggatttatgggcaaagactgcaaggagcaaagatgtccca

SEQ ID NO: 910 - DNA, 94 bp, Artificial
  Synthetic oligonucleotide
gtgactgtcatggccagggccgctgcgtggacggccagtgcatctgccacgagggcttcacaggcctggactgtggccagcactcctgccccag

SEQ ID NO: 911 - DNA, 80 bp, Artificial
  Synthetic oligonucleotide
tgactgcaacaacttaggacaatgcgtctcgggccgctgcatctgcaacgagggctacagcggagaagactgctcagagg

SEQ ID NO: 912 - DNA, 116 bp, Artificial
  Synthetic oligonucleotide
acttacctgcacctgaaggcctgaaattcaagtccatcaaggagacatctgtggaagtggagtgggatcctctagacattgcttttgaaacctgggagatcatcttccggaatatg

SEQ ID NO: 913 - DNA, 66 bp, Artificial
  Synthetic oligonucleotide
gtgagtatcacctttaatacttatagaatgataaggctgattgtacctcgtaacactcctgattaa

SEQ ID NO: 914 - DNA, 90 bp, Artificial
  Synthetic oligonucleotide
gcctcgatgctcccaggaatcttcgacgtgtttcccagacagataacagcatcaccctggaatggaggaatggcaaggcagctattgaca

SEQ ID NO: 915 - DNA, 96 bp, Artificial
  Synthetic oligonucleotide
gttacagaattaagtatgcccccatctctggaggggaccacgctgaggttgatgttccaaagagccaacaagccacaaccaaaaccacactcacag

SEQ ID NO: 916 - DNA, 90 bp, Artificial
  Synthetic oligonucleotide
gtctgaggccgggaactgaatatgggattggagtttctgctgtgaaggaagacaaggagagcaatccagcgaccatcaacgcagccacag

SEQ ID NO: 917 - DNA, 66 bp, Artificial
  Synthetic oligonucleotide
gtatatgaccctcctcccagactggagacatgataggagccagcatgtcattgaaatagagaaaat

SEQ ID NO: 918 - DNA, 35 bp, Artificial
  Synthetic oligonucleotide
ctctggatggcccatctggcctggtgacagccaac

SEQ ID NO: 919 - DNA, 85 bp, Artificial
  Synthetic oligonucleotide
atcactgactcagaagccttggccaggtggcagccagccattgccactgtggacagttatgtcatctcctacacaggcgagaaag

SEQ ID NO: 920 - DNA, 18 bp, Artificial
  Synthetic oligonucleotide
ctgccaagttcacaacag

SEQ ID NO: 921 - DNA, 84 bp, Artificial
  Synthetic oligonucleotide
acctcgattctccaagagacttgactgctactgaggttcagtcggaaactgccctccttacctggcgacccccccgggcatcag

SEQ ID NO: 922 - DNA, 47 bp, Artificial
  Synthetic oligonucleotide
tcaccggttacctgctggtctatgaatcagtggatggcacagtcaag

SEQ ID NO: 923 - DNA, 44 bp, Artificial
  Synthetic oligonucleotide
ttggactcctgtaccccttccccaaggactgctcccaagcaatg

SEQ ID NO: 924 - DNA, 81 bp, Artificial
  Synthetic oligonucleotide
ctgaatggagacacgacctctggcctctacaccatttatctgaatggtgataaggctcaggcgctggaagtcttctgtgac

SEQ ID NO: 925 - DNA, 5 bp, Artificial
  Synthetic oligonucleotide
atgac

SEQ ID NO: 926 - DNA, 22 bp, Artificial
  Synthetic oligonucleotide
ctctgatgggggtggatggatt

SEQ ID NO: 927 - DNA, 97 bp, Artificial
  Synthetic oligonucleotide
gtgttcctgagacgcaaaaacggacgcgagaacttctaccaaaactggaaggcatatgctgctggatttggggaccgcagagaagaattctggcttg

SEQ ID NO: 928 - DNA, 52 bp, Artificial
  Synthetic oligonucleotide
cactgggtgagagaggaataaggcccagagcgaggaaaggattttaccaaag

SEQ ID NO: 929 - DNA, 58 bp, Artificial
  Synthetic oligonucleotide
catcaatacaaccagcccaaccatcggtccacacctgggcatttggtgagagtcaaag

SEQ ID NO: 930 - DNA, 91 bp, Artificial
  Synthetic oligonucleotide
ctgaccatggatccctggggccaacggcaacagcatgggcctcacctcctctgtgatttctttctttgcaccaaagacatcagtctccaac

SEQ ID NO: 931 - DNA, 58 bp, Artificial
  Synthetic oligonucleotide
atgtttctgttttgttgtttgattcagcaaaaatctcccagtgacaacatcgcaatag

SEQ ID NO: 932 - DNA, 59 bp, Artificial
  Synthetic oligonucleotide
ttttttacttctcttaggtggctctgggaatgggagaggggtaggatgtacaggggtag

SEQ ID NO: 933 - protein, 2201 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGLDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 934 - protein, 2293 aa, Homo sapiens [sequence omitted]

SEQ ID NO: 935 - protein, 1658 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEPKPQLGTLIFSNITPKSFNMSWTTQAGLFAKIVINVSDAHSLHESQQFTVSGDAKQAHITGLVENTGYDVSVAGTTLAGDPTRPLTAFVITGTQSEVLTCLTQREKEISHLKGKFNKNTIFTANVYSLIFN

SEQ ID NO: 936 - protein, 1673 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTGISNQVSHLFLFLVPFCVICLPDRHDFNIFVHIPYLIHKCSLLFHLLPTLPLVICT

SEQ ID NO: 937 - protein, 2110 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 938 - protein, 2110 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 939 - protein, 1928 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 940 - protein, 1837 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 941 - protein, 2091 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVSTTRDCRALRPRGRGRGQSRGGEEGDLLLMHSDTPMCEALQDSACHTEALRNSLLNKRMGNTLATF

SEQ ID NO: 942 - protein, 1655 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 943 - protein, 1564 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 944 - protein, 2067 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVTPWPTTMADPSPPLTRTQIQPSPTVLCPTKGLSGTGTVTVST

SEQ ID NO: 945 - protein, 2065 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGNAALHVYI

SEQ ID NO: 946 - protein, 1730 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDLTGLREATEYEIELYGISKGRRSQTVSAIATTGTVNKQERTEKSHDSGVFFSQG

SEQ ID NO: 947 - protein, 1346 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTGI

SEQ ID NO: 948 - protein, 1292 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTGILDEFTNSLPPLCLCSGGIKALSCFKLGSAPTTLGKYQ

SEQ ID NO: 949 - protein, 1083 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTGESALSFLQTLG

SEQ ID NO: 950 - protein, 970 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGELCISASLSQPALEGP

SEQ ID NO: 951 - protein, 806 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTREYHL

SEQ ID NO: 952 - protein, 712 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATCE

SEQ ID NO: 953 - protein, 1189 aa, Homo sapiens
EGLGEQASWAMVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 954 - protein, 717 aa, Homo sapiens [sequence omitted]

SEQ ID NO: 955 - DNA, 26 bp, Homo sapiens
gaaggctcttgtcacttactagccat

SEQ ID NO: 956 - DNA, 24 bp, Homo sapiens
tgtcaccatatttaatcctcccaa

SEQ ID NO: 957 - DNA, 101 bp, Artificial
  Synthetic oligonucleotide
gaaggctcttgtcacttactagccatgtgattttggaaagaaacttaacattaattccttcagctacaatggaattcttgggaggattaaatatggtgaca

SEQ ID NO: 958 - protein, 524 aa, Homo sapiens [sequence omitted]

SEQ ID NO: 959 - protein, 344 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDGPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 960 - DNA, 21 bp, Homo sapiens
ccagcaatccacacaagagct

SEQ ID NO: 961 - DNA, 21 bp, Homo sapiens
cagggtctggtccaatcagag

SEQ ID NO: 962 - DNA, 144 bp, Homo sapiens
ccagcaatccacacaagagctctttatccccaacatcactgtgaataatagcggatcctatatgtgccaagcccataactcagccactggcctcaataggaccacagtcacgatgatcacagtctctgattggaccagaccctg

SEQ ID NO: 963 - protein, 901 aa, Homo sapiens [sequence omitted]

SEQ ID NO: 964 - protein, 821 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 965 - DNA, 18 bp, Homo sapiens
accagccacctcaaccca

SEQ ID NO: 966 - DNA, 22 bp, Homo sapiens
ctggagcagagagtctttgcct

SEQ ID NO: 967 - DNA, 110 bp, Homo sapiens
accagccacctcaacccaaggccctgggcaatcagcagccttcgtgggattcagaggatagcagcaacttcaaagatgtaggttcaaaaggcaaagactctctgctccag

SEQ ID NO: 968 - protein, 112 aa, Homo sapiens; identical to SEQ ID NO: 142

SEQ ID NO: 969 - protein, 141 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 970 - protein, 165 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLASSRHTAELKEMPPPPALFFQPSPPTPHLPE

SEQ ID NO: 971 - protein, 164 aa, Homo sapiens [sequence omitted]

SEQ ID NO: 972 - protein, 157 aa, Homo sapiens
MQAPRAAPAAPLSYDRRLRGSIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 973 - DNA, 26 bp, Homo sapiens
acactaaaagaacaaacaccttgctc

SEQ ID NO: 974 - DNA, 22 bp, Homo sapiens
tcctcagaaggcacatgaaaga

SEQ ID NO: 975 - DNA, 106 bp, Homo sapiens
acactaaaagaacaaacaccttgctcttcgagatgagacattttgccaagcagttgaccacttagttctcaagaagcaactatctctttcatgtgccttctgagga

SEQ ID NO: 976 - DNA, 20 bp, Homo sapiens
agtgatggagcaaagtgccg

SEQ ID NO: 977 - DNA, 21 bp, Homo sapiens
cagcagctgatgcaaactgag

SEQ ID NO: 978 - DNA, 132 bp, Homo sapiens
agtgatggagcaaagtgccgggatcatgtaccgcaagtcctgtgcatcatcagcggcctgtctcatcgcctctgccgggtaccagtccttctgctccccagggaaactgaactcagtttgcatcagctgctg

SEQ ID NO: 979 - DNA, 21 bp, Artificial
  Synthetic oligonucleotide
aatgccgcttcttaaacacca

SEQ ID NO: 980 - DNA, 28 bp, Artificial
  Synthetic oligonucleotide
agaactggcatttttctgaaaataataa

SEQ ID NO: 981 - DNA, 140 bp, Artificial
  Synthetic oligonucleotide
aatgccgcttcttaaacaccatacagagtgaacccatttacttttctccagttcctaagttaccaggggcaattatatctcacataaacattcctttagatttttattttacttattattttcagaaaaatgccagttct

SEQ ID NO: 982 - DNA, 27 bp, Artificial
  Synthetic oligonucleotide
tggtttttctcttagttgattcagacc

SEQ ID NO: 983 - DNA, 19 bp, Artificial
  Synthetic oligonucleotide
gagccactggctgcttcag

SEQ ID NO: 984 - DNA, 107 bp, Artificial
  Synthetic oligonucleotide
tggtttttctcttagttgattcagaccttgcatgctgttgacaaggatgacccttatagtgggcaccaattttcgttttccttggcccctgaagcagccagtggctc

SEQ ID NO: 985 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSVQEALSGTPCLLGPGPVLTVLALLLASTLA

SEQ ID NO: 986 - protein, 621 aa, Homo sapiens [sequence omitted]

SEQ ID NO: 987 - protein, 343 aa, Homo sapiens
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESSE

SEQ ID NO: 988 - protein, 836 aa, Homo sapiens [sequence omitted]

SEQ ID NO: 989 - protein, 836 aa, Homo sapiens [sequence omitted]

SEQ ID NO: 990 - protein, 649 aa, Homo sapiens
MQEGVKMALHLPWFHPRNVSGFSIANRSSIKRLCIIESVFEGEGSATLMSANYPEGFPEDELMTCQFVVPAHLRASVSFLNFNLSNCERKEERVEYYIPGSTTNPEVFKLEDKQPGNMAGNFNLSLQGCDQDAQSPGILRLQFQVLVQHPQNESNKIYVVDLSNERAMSLTIEPRPVKQSRKFVPGCFVCLESRTCSSNLTLTSGSKHKISFLCDDLTRLWMNVEKTISCTDHRYCQRKSYSLQVPGDILHLPVELHDFSWKLLVPKDRLSLVLVPAQKLQQHTHEKPCNTSFSYLVASAIPSQDLYFGSFCPGGSIKQIQVKQNISVTLRTFAPSFRQEASRQGLTVSFIPYFKEEGVFTVTPDTKSKVYLRTPNWDRGLPSLTSVSWNISVPRDQVACLTFFKERSGVVCQTGRAFMIIQEQRTRAEEIFSLDEDVLPKPSFHHHSFWVNISNCSPTSGKQLDLLFSVTLTPRTVDLTVILIAAVGGGVLLLSALGLIICCVKKKKKKTNKGPAVGIYNGNINTEMPRQPKKFQKGRKDNDSHVYAVIEDTMVYGHLLQDSSGSFLQPEVDTYRPFQGTMGVCPPSPPTICSRAPTAKLATEEPPPRSPPESESEPYTFSHPNNGDVSSKDTDIPLLNTQEPMEPAE

SEQ ID NO: 991 - DNA, 21 bp, Artificial
  Synthetic oligonucleotide
accccaaacccaacttgattc

SEQ ID NO: 992 - DNA, 21 bp, Artificial
  Synthetic oligonucleotide
tcagtggtggagccaagtctc

SEQ ID NO: 993 - DNA, 101 bp, Artificial
  Synthetic oligonucleotide
accccaaacccaacttgattcctgccatatggaggaggctctggagtcctgctctgtgtggtccaggtcctttccaccctgagacttggctccaccactga

SEQ ID NO: 994 - DNA, 22 bp, Artificial
  Synthetic oligonucleotide
ctcctgaaccctactccaagca

SEQ ID NO: 995 - DNA, 21 bp, Artificial
  Synthetic oligonucleotide
caggcgatcctatggaaatcc

SEQ ID NO: 996 - DNA, 101 bp, Artificial
  Synthetic oligonucleotide
ctcctgaaccctactccaagcacagcctctgtctgactcccttgtccttcaagagaactgttctccaggtctcagggccaggatttccataggatcgcctg

SEQ ID NO: 997 - DNA, 20 bp, Artificial
  Synthetic oligonucleotide
caagcaattgagggaccagg

SEQ ID NO: 998 - DNA, 29 bp, Artificial
  Synthetic oligonucleotide
caaaaaacattgttaatgagagagatgac

SEQ ID NO: 999 - DNA, 113 bp, Artificial
  Synthetic oligonucleotide
caagcaattgagggaccaggaagtggatcctctagagatgaggaggcattctgctggatgacttttaaaaatgttttctccagagtcatctctctcattaacaatgttttttg

SEQ ID NO: 1000 - protein, 478 aa, Homo sapiens; identical to SEQ ID NO: 602

SEQ ID NO: 1001 - DNA, 20 bp, Artificial
  Synthetic oligonucleotide
ggggcagaacctctgacaag

SEQ ID NO: 1002 - DNA, 17 bp, Artificial
  Synthetic oligonucleotide
gggcagcccagccagta

SEQ ID NO: 1003 - DNA, 109 bp, Artificial
  Synthetic oligonucleotide
ggggcagaacctctgacaagtactaccgagtcaatcttcgcacacggcgagtggacactgtggaccctccctacccacgctccatcgctcagtactggctgggctgccc

SEQ ID NO: 1004 - DNA, 25 bp, Artificial
  Synthetic oligonucleotide
gaaggcacaggaaaaacagatattg

SEQ ID NO: 1005 - DNA, 21 bp, Artificial
  Synthetic oligonucleotide
tggtgctcttggtcacaggat

SEQ ID NO: 1006 - DNA, 119 bp, Artificial
  Synthetic oligonucleotide
gaaggcacaggaaaaacagatattgcatcacgttaccctaccctttggactgaacaggttaaaagtcggcagaacaaaaccaataagaattcagtgtcatcctgtgaccaagagcacca

SEQ ID NO: 1007 - protein, 133 aa, Homo sapiens [sequence omitted]

SEQ ID NO: 1008 - DNA, 24 bp, Artificial
  Synthetic oligonucleotide
ccaccagttaactacaagtgcctg

SEQ ID NO: 1009 - DNA, 18 bp, Artificial
  Synthetic oligonucleotide
gcgtgcatgagctgcatg

SEQ ID NO: 1010 - DNA, 104 bp, Artificial
  Synthetic oligonucleotide
ccaccagttaactacaagtgcctgcagctctacgccccagggctgtcgccagacactatcatggagtgtgcaatgggggaccgcggcatgcagctcatgcacgc

SEQ ID NO: 1011 - DNA, 50 bp, Homo sapiens
ccccagcttttatagagcggcccaaggaagaatatttccaagaagtaggg

SEQ ID NO: 1012 - DNA, 50 bp, Homo sapiens
ggaacattctggatctgaccctcccagtctcatctcctgaccctcccact

SEQ ID NO: 1013 - DNA, 50 bp, Homo sapiens
gctgatatggaagttggggaatctgaattgccagagaatcttgggaagag

SEQ ID NO: 1014 - DNA, 50 bp, Homo sapiens
tctcatagaagcaaaggagaacagaaaccaccagccacctcaacccaagg

SEQ ID NO: 1015 - DNA, 50 bp, Homo sapiens
tctgacttttacggacttggcttgttagaaggctgaaagatgatggcagg

SEQ ID NO: 1016 - DNA, 50 bp, Homo sapiens
agtctgtgtttgagggtgaaggctcagcaaccctgatgtctgccaactac

SEQ ID NO: 1017 - DNA, 50 bp, Homo sapiens
aactctggcaccttgggctgtggaaggctctggaaagtccttcaaagctg

SEQ ID NO: 1018 - DNA, 50 bp, Homo sapiens
aaaagcatgagtttctgaccagcgttctggacgcgctgtccacggacatg

SEQ ID NO: 1019 - DNA, 50 bp, Homo sapiens
atgttcttaggaggcaagccaggagaagccgggtctgacttttcagctca

SEQ ID NO: 1020 - DNA, 50 bp, Homo sapiens
tcctccagacccaaagccacaacccatcgcaagtcaagaacactttccag

SEQ ID NO: 1021 - DNA, 50 bp, Homo sapiens
cacagagccaggatgttcttctgacctcagtatctactccagctccagct

SEQ ID NO: 1022 - DNA, 50 bp, Homo sapiens
tggcatgctggaacatggactctagctagcaagaagggctcaaggaggtg

SEQ ID NO: 1023 - DNA, 50 bp, Homo sapiens
gcaggggttaaaaggacgttccagaagcatctggggacagaaccagcctc

SEQ ID NO: 1024 - DNA, 50 bp, Homo sapiens
taataaacgcagcgacgtgagggtcctgattctccctggttttaccccag

SEQ ID NO: 1025 - DNA, 50 bp, Homo sapiens
aaggaagcaggaccagtggatgtgaggcgtggtcgaagaacaacagaaag

SEQ ID NO: 1026 - DNA, 50 bp, Homo sapiens
acaggggccagatggtgacccatgacccagcctaaaaggcagccagaggg

SEQ ID NO: 1027 - DNA, 50 bp, Homo sapiens
cttcctacacacatctagacgttcaagtttgcaaatcagtttttagcaag

SEQ ID NO: 1028 - DNA, 50 bp, Homo sapiens
aaaaggagacttcggctacccagagaagttcagtgcccagctctactgag

SEQ ID NO: 1029 - DNA, 50 bp, Homo sapiens
aaaggctggcatagggggaggtttcccaggtagaagaagaagtgtcagca

SEQ ID NO: 1030 - DNA, 50 bp, Homo sapiens
aattaaccctttgagagctggccaggactctggactgattaccccagcct

SEQ ID NO: 1031 - DNA, 50 bp, Homo sapiens; identical to SEQ ID NO: 1011

SEQ ID NO: 1032 - DNA, 2277 bp, Homo sapiens
gactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcgcagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggacggtctctgcgatatgataccagctattttgtggagtattttgccttggatctcctgatggagaacggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtcgatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacagacctggtggagaccctggagctgcagaacctgatgctgtgtgcgctgcagaccatctacggagcagaggcgcggaaggagtcacggggcgcgcatgccagggaagactacaaggtgcggattgatgagtacgattactccaagcccatccaggggcaacagaagaagccctttgaggagcactggaggaagcacaccctgtcctttgtggacgttggcactgggaaggtcactctggaatatagacccgtaatcgacaaaactttgaacgaggctgactgtgccaccatcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgag

SEQ ID NO: 1033 - DNA, 20 bp, Artificial
  Synthetic oligonucleotide
tgggaacaagagggcatctg

SEQ ID NO: 1034 - DNA, 22 bp, Artificial
  Synthetic oligonucleotide
ccaccactgcatcaaattcatg

SEQ ID NO: 1035 - DNA, 86 bp, Artificial
  Synthetic oligonucleotide
tgggaacaagagggcatctgctaaagtttcagattccatttctgctcagtatccagtagtggatcatgaatttgatgcagtggtgg

SEQ ID NO: 1036 - DNA, 1536 bp, Homo sapiens
gtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtaaaaaaaaaaaaaaaaaaaaaaaaaaaaaaaaaaa

SEQ ID NO: 1037 - DNA, 19 bp, Artificial
  Synthetic oligonucleotide
tgagagtgattcgcgtggg

SEQ ID NO: 1038 - DNA, 21 bp, Artificial
  Synthetic oligonucleotide
ccagggtacgaggctttcaat

SEQ ID NO: 1039 - DNA, 91 bp, Artificial
  Synthetic oligonucleotide
tgagagtgattcgcgtgggtacccgcaagagccagcttgctcgcatacagacggacagtgtggtggcaacattgaaagcctcgtaccctgg

SEQ ID NO: 1040 - DNA, 1331 bp, Homo sapiens
tcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaattt

SEQ ID NO: 1041 - DNA, 21 bp, Artificial
  Synthetic oligonucleotide
tgacactggcaaaacaatgca

SEQ ID NO: 1042 - DNA, 21 bp, Artificial
  Synthetic oligonucleotide
ggtccttttcaccagcaagct

SEQ ID NO: 1043 - DNA, 94 bp, Artificial
  Synthetic oligonucleotide
tgacactggcaaaacaatgcagactttgctttccttggtcaggcagtataatccaaagatggtcaaggtcgcaagcttgctggtgaaaaggacc

SEQ ID NO: 1044 - DNA, 1261 bp, Homo sapiens
cttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaaaaa

SEQ ID NO: 1045 - DNA, 20 bp, Artificial
  Synthetic oligonucleotide
tgcaccaccaactgcttagc

SEQ ID NO: 1046 - DNA, 19 bp, Artificial
  Synthetic oligonucleotide
ccatcacgccacagtttcc

SEQ ID NO: 1047 - DNA, 116 bp, Artificial
  Synthetic oligonucleotide
tgcaccaccaactgcttagcacccctggccaaggtcatccatgacaactttggtatcgtggaaggactcatgaccacagtccatgccatcactgccacccagaagactgtggatgg

SEQ ID NO: 1048 - DNA, 748 bp, Homo sapiens
gcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgcaaaaaaaaaaaaaaaa

SEQ ID NO: 1049 - DNA, 23 bp, Artificial
  Synthetic oligonucleotide
tggcaagaagaaggtctggttag

SEQ ID NO: 1050 - DNA, 22 bp, Artificial
  Synthetic oligonucleotide
tgatcagcccatctttgatgag

SEQ ID NO: 1051 - DNA, 101 bp, Artificial
  Synthetic oligonucleotide
tggcaagaagaaggtctggttagaccccaatgagaccaatgaaatcgccaatgccaactcccgtcagcagatccggaagctcatcaaagatgggctgatca

SEQ ID NO: 1052 - DNA, 1867 bp, Homo sapiens
ggttcgctgtggcgggcgcctgggccgccggctgtttaacttcgcttccgctggcccatagtgatctttgcagtgacccagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttaaaaaaaaaaaaaaaaaaaaaa

SEQ ID NO: 1053 - DNA, 20 bp, Artificial
  Synthetic oligonucleotide
cggtttgctgcggtaatcat

SEQ ID NO: 1054 - DNA, 21 bp, Artificial
  Synthetic oligonucleotide
tttcttgctgccagtctggac

SEQ ID NO: 1055 - DNA, 122 bp, Artificial
  Synthetic oligonucleotide
cggtttgctgcggtaatcatgaggataagagagccacgaaccacggcactgattttcagttctgggaaaatggtgtgcacaggagccaagagtgaagaacagtccagactggcagcaagaaa

SEQ ID NO: 1056 - DNA, 2201 bp, Homo sapiens
cgggatttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgatcagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaaaaaaaaaaaaaaaaaaaaaaaa

SEQ ID NO: 1057 - DNA, 19 bp, Artificial
  Synthetic oligonucleotide
atttgggtcgcggttcttg

SEQ ID NO: 1058 - DNA, 21 bp, Artificial
  Synthetic oligonucleotide
tgccttgacattctcgatggt

SEQ ID NO: 1059 - DNA, 133 bp, Artificial
  Synthetic oligonucleotide
atttgggtcgcggttcttgtttgtggatcgctgtgatcgtcacttgacaatgcagatcttcgtgaagactctgactggtaagaccatcaccctcgaggttgagcccagtgacaccatcgagaatgtcaaggca

SEQ ID NO: 1060 - protein, 40 aa, Artificial
  Synthetic peptide
EEEVSADQVSVGASGVLGSFKEARNAPSFLSWSFSMGPSK

SEQ ID NO: 1061 - protein, 11 aa, Artificial
  Synthetic peptide
ICHIWKLIFLP

SEQ ID NO: 1062 - protein, 5 aa, Artificial
  Synthetic peptide
LMDQK

SEQ ID NO: 1063 - protein, 5 aa, Artificial
  Synthetic peptide
SQDLH

SEQ ID NO: 1064 - protein, 44 aa, Artificial
  Synthetic peptide
FGSGLVPMSPTSLLLLARLYFTWDMLLCWDSCMSTGLSSTCSRP

SEQ ID NO: 1065 - protein, 33 aa, Artificial
  Synthetic peptide
GQVRWLTPVIPALWEAKAGGSPEVRSSILAWPT

SEQ ID NO: 1066 - protein, 47 aa, Artificial
  Synthetic peptide
GCWPSRQSREQHISSRRKMEILKTECQEKESRTIHSMRRKMEKKNFI

SEQ ID NO: 1067 - protein, 15 aa, Artificial
  Synthetic peptide
MDPDWCQCLQLHFCS

SEQ ID NO: 1068 - protein, 15 aa, Artificial
  Synthetic peptide
NSPGSADSIPPVPAG

SEQ ID NO: 1069 - protein, 15 aa, Artificial
  Synthetic peptide
NSPGSADSIPPVPAG

SEQ ID NO: 1070 - protein, 30 aa, Artificial
  Synthetic peptide
RKSWSSSRPITSMFLSPGSPEPASANTARS

SEQ ID NO: 1071 - protein, 83 aa, Artificial
  Synthetic peptide
MRLSPAPLKLSRTPALLALALPLAAALAFSDETLDKVPKSEGYCSRILRAQGTRREGYTEFSLRVEGDPDFYKPGTSYRVTLS

SEQ ID NO: 1072 - protein, 83 aa, Artificial; identical to SEQ ID NO: 1071
  Synthetic peptide

SEQ ID NO: 1073 - protein, 10 aa, Artificial
  Synthetic peptide
VRQKNHRMTK

SEQ ID NO: 1074 - protein, 83 aa, Artificial; identical to SEQ ID NO: 1071
  Synthetic peptide

SEQ ID NO: 1075 - protein, 7 aa, Artificial
  Synthetic peptide
TQGVVGD

SEQ ID NO: 1076 - protein, 15 aa, Artificial
  Synthetic peptide
VPGAVGQGRKHLGRV

SEQ ID NO: 1077 - protein, 23 aa, Artificial
  Synthetic peptide
DAMVVSSRPKATTHRKSRTLSRR

SEQ ID NO: 1078 - protein, 6 aa, Artificial
  Synthetic peptide
RSKRNL

SEQ ID NO: 1079 - protein, 13 aa, Artificial
  Synthetic peptide
LLWLRGKVSFYCF

SEQ ID NO: 1080 - protein, 99 aa, Artificial
  Synthetic peptide
VRWATLELYLIGYYYCSFSQACSKKPSPPLRAVEAGTREWLWVRVVSGGNFLCSGFGLTQAGTQILPYRLHDCGQITFSKCNCKTGINNTNLVGLLGSL

SEQ ID NO: 1081 - protein, 62 aa, Artificial
  Synthetic peptide
DVLTAWPSIYRRQVKVLREDEITILPWHLQWSREKATKLLRPTLPSYNNHGWEELRVGKSIV

SEQ ID NO: 1082 - protein, 10 aa, Artificial
  Synthetic peptide
MEKLQLRNVK

SEQ ID NO: 1083 - protein, 9 aa, Artificial
  Synthetic peptide
MWLPLSGAA

SEQ ID NO: 1084 - protein, 5 aa, Artificial
  Synthetic peptide
GKAGV

SEQ ID NO: 1085 - protein, 31 aa, Artificial
  Synthetic peptide
PGLERGADKFPVVGGSSLFLALDLTLRPPVG

SEQ ID NO: 1086 - protein, 17 aa, Artificial
  Synthetic peptide
VWAATGRRVARVGMLSL

SEQ ID NO: 1087 - protein, 12 aa, Artificial
  Synthetic peptide
LWTSLLALTIPS

SEQ ID NO: 1088 - protein, 17 aa, Artificial
  Synthetic peptide
VWAATGRRVARVGMLSL

SEQ ID NO: 1089 - protein, 26 aa, Artificial
  Synthetic peptide
VRIFLALSLTLIVPWSQGWTRQRDQR

SEQ ID NO: 1090 - protein, 41 aa, Artificial
  Synthetic peptide
NPWKIRPSSLPLSASCTRARSRMSALPQPAPSGVFASSDGR

SEQ ID NO: 1091 - protein, 5 aa, Artificial
  Synthetic peptide
GGTSM

SEQ ID NO: 1092 - protein, 15 aa, Artificial
  Synthetic peptide
KCFQEHLEFGYSTAM

SEQ ID NO: 1093 - protein, 34 aa, Artificial
  Synthetic peptide
GEYPASSETHRRIWNVIYPITVSVIILFQISTKE

SEQ ID NO: 1094 - protein, 10 aa, Artificial
  Synthetic peptide
LLRLTGEYGM

SEQ ID NO: 1095 - protein, 15 aa, Artificial
  Synthetic peptide
MPLTMGKRNLFLLTP

SEQ ID NO: 1096 - protein, 13 aa, Artificial
  Synthetic peptide
CKYCIIHQSTKLF

SEQ ID NO: 1097 - protein, 30 aa, Artificial
  Synthetic peptide
GTSSPYCTCYMTKRQGQGSLSFKKKSSLLC

SEQ ID NO: 1098 - protein, 131 aa, Artificial
  Synthetic peptide
PKPQLGTLIFSNITPKSFNMSWTTQAGLFAKIVINVSDAHSLHESQQFTVSGDAKQAHITGLVENTGYDVSVAGTTLAGDPTRPLTAFVITGTQSEVLTCLTQREKEISHLKGKFNKNTIFTANVYSLIFN

SEQ ID NO: 1099 - protein, 56 aa, Artificial
  Synthetic peptide
GISNQVSHLFLFLVPFCVICLPDRHDFNIFVHIPYLIHKCSLLFHLLPTLPLVICT

SEQ ID NO: 1100 - protein, 66 aa, Artificial
  Synthetic peptide
STTRDCRALRPRGRGRGQSRGGEEGDLLLMHSDTPMCEALQDSACHTEALRNSLLNKRMGNTLATF

SEQ ID NO: 1101 - protein, 42 aa, Artificial
  Synthetic peptide
TPWPTTMADPSPPLTRTQIQPSPTVLCPTKGLSGTGTVTVST

SEQ ID NO: 1102 - protein, 8 aa, Artificial
  Synthetic peptide
NAALHVYI

SEQ ID NO: 1103 - protein, 22 aa, Artificial
  Synthetic peptide
GTVNKQERTEKSHDSGVFFSQG

SEQ ID NO: 1104 - protein, 39 aa, Artificial
  Synthetic peptide
GILDEFTNSLPPLCLCSGGIKALSCFKLGSAPTTLGKYQ

SEQ ID NO: 1105 - protein, 12 aa, Artificial
  Synthetic peptide
GESALSFLQTLG

SEQ ID NO: 1106 - protein, 16 aa, Artificial
  Synthetic peptide
ELCISASLSQPALEGP

SEQ ID NO: 1107 - protein, 4 aa, Artificial
  Synthetic peptide
EYHL

SEQ ID NO: 1108 - protein, 6 aa, Artificial
  Synthetic peptide
VFLNFS

SEQ ID NO: 1109 - protein, 8 aa, Artificial
  Synthetic peptide
VSIFYVFI

SEQ ID NO: 1110 - protein, 69 aa, Artificial
  Synthetic peptide
DCGFPAFRELKRAETVSPVFFTRRCIWEDLKSTGFSPAGGGRPPGGGPRTQEDSGLPCWRSSCSVTLQV

SEQ ID NO: 1111 - protein, 22 aa, Artificial
  Synthetic peptide
PHSGPAAAFIRRRGWWPGPRCA

SEQ ID NO: 1112 - protein, 42 aa, Artificial
  Synthetic peptide
LPPRCPLANRVDFSWAGREYRLQTFSKPLIFLANVFLQTQRP

SEQ ID NO: 1113 - protein, 28 aa, Artificial
  Synthetic peptide
KWRGWRGGCMARSLVAGAACGQHLGTRP

SEQ ID NO: 1114 - protein, 5 aa, Artificial
  Synthetic peptide
DWTRP

SEQ ID NO: 1115 - protein, 22 aa, Artificial
  Synthetic peptide
LLLSSQLWPPSASRLECWPGWL

SEQ ID NO: 1116 - protein, 70 aa, Artificial
  Synthetic peptide
KWIHEALASHFQVESGSQRRARKKFSFPTCVQGAHANPKFSPEPSQFTSADSFPLVFLFFVVFCFLISHV

SEQ ID NO: 1117 - protein, 42 aa, Artificial
  Synthetic peptide
REYFHMTSGCWGSVLLPTYGIVRPGLCLWPSLHYILYQGLDI

SEQ ID NO: 1118 - protein, 48 aa, Artificial
  Synthetic peptide
TACRSRIANSCHSGDSWRNSCFANSDSAALAVSSEESGGQRALTAPRG

SEQ ID NO: 1119 - protein, 37 aa, Artificial
  Synthetic peptide
VRGQEDPEGVEDKCVLAQSRGQSKILLGQLSVNTVMV

SEQ ID NO: 1120 - protein, 145 aa, Artificial
  Synthetic peptide
VGTATGRAGWREQAPCRGTRLLLSPQTSQGKTRAPRGRCPCRVPGKTLFSSRRCGHTPSVPFRFRIPHLRGAAASTRLVPPKGSMSAYCVLLGQELGSPFVAQGTSSAAGQGPPACILAATLDAFIPARAGLACLWDLLGRCPRG

SEQ ID NO: 1121 - protein, 90 aa, Artificial
  Synthetic peptide
MTLSPLLLFLPPLLLLLDVPTAAVQASPLQALDFFGNGPPVNYKTGNLYLRGPLKKSNAPLVNVTLYYEALCGGCRAFLIRELFPTWLLV

SEQ ID NO: 1122 - protein, 90 aa, Artificial; identical to SEQ ID NO: 1121
  Synthetic peptide

SEQ ID NO: 1123 - protein, 90 aa, Artificial; identical to SEQ ID NO: 1121
  Synthetic peptide

SEQ ID NO: 1124 - protein, 38 aa, Artificial
  Synthetic peptide
KPLEDQTQLLTLVCQLYQGKKPDVCPSSTSSLRSVCFK

SEQ ID NO: 1125 - protein, 15 aa, Artificial
  Synthetic peptide
DSLLQVLNVKEGTPS

SEQ ID NO: 1126 - protein, 110 aa, Artificial
  Synthetic peptide
MWVLGIAATFCGLFLLPGFALQIQCYQCEEFQLNNDCSSPEFIVNCTVNVQDMCQKEVMEQSAGIMYRKSCASSAACLIASAGSPCRGLAPGREEQRALHKAGAVGGGVR

SEQ ID NO: 1127 - protein, 139 aa, Artificial
  Synthetic peptide
SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 1128 - protein, 29 aa, Artificial
  Synthetic peptide
SHCVTRLECSGTISAHCNLCLPGSNDHPT

SEQ ID NO: 1129 - protein, 5 aa, Artificial
  Synthetic peptide
MWVLG

SEQ ID NO: 1130 - protein, 21 aa, Artificial
  Synthetic peptide
DTKRTNTLLFEMRHFAKQLTT

SEQ ID NO: 1131 - protein, 27 aa, Artificial
  Synthetic peptide
DRVSLCHEAGVQWNNFSTLQPLPPRLK

SEQ ID NO: 1132 - protein, 5 aa, Artificial
  Synthetic peptide
MWVLG

SEQ ID NO: 1133 - protein, 7 aa, Artificial
  Synthetic peptide
RFGFSLS

SEQ ID NO: 1134 - protein, 10 aa, Artificial
  Synthetic peptide
VMPLLKHHTE

SEQ ID NO: 1135 - protein, 495 aa, Artificial
  Synthetic peptide
NKIYVVDLSNERAMSLTIEPRPVKQSRKFVPGCFVCLESRTCSSNLTLTSGSKHKISFLCDDLTRLWMNVEKTISCTDHRYCQRKSYSLQVPSDILHLPVELHDFSWKLLVPKDRLSLVLVPAQKLQQHTHEKPCNTSFSYLVASAIPSQDLYFGSFCPGGSIKQIQVKQNISVTLRTFAPSFQQEASRQGLTVSFIPYFKEEGVFTVTPDTKSKVYLRTPNWDRGLPSLTSVSWNISVPRDQVACLTFFKERSGVVCQTGRAFMIIQEQRTRAEEIFSLDEDVLPKPSFHHHSFWVNISNCSPTSGKQLDLLFSVTLTPRTVDLTVILIAAVGGGVLLLSALGLIICCVKKKKKKTNKGPAVGIYNGNINTEMPRQPKKFQKGRKDNDSHVYAVIEDTMVYGHLLQDSSGSFLQPEVDTYRPFQGTMGVCPPSPPTICSRAPTAKLATEEPPPRSPPESESEPYTFSHPNNGDVSSKDTDIPLLNTQEPMEPAE

SEQ ID NO: 1136 - protein, 146 aa, Artificial
  Synthetic peptide
NKIYVVDLSNERAMSLTIEPRPVKQSRKFVPGCFVCLESRTCSSNLTLTSGSKHKISFLCDDLTRLWMNVEKTISTPLNQCICPWPWIALLSPPCLSGVPWVGCKSYQKGPSGRARWLTPVIPALWEAKAGGSLEVRSSRPAWPTW

SEQ ID NO: 1137 - protein, 19 aa, Artificial
  Synthetic peptide
EKAPPCYLIRLKHTRSSLF

SEQ ID NO: 1138 - protein, 8 aa, Artificial
  Synthetic peptide
GKQGMRAH

SEQ ID NO: 1139 - protein, 25 aa, Artificial
  Synthetic peptide
GEKRHHKQLRDQEVDPLEMRRHSAG

SEQ ID NO: 1140 - protein, 8 aa, Artificial
  Synthetic peptide
RGSLGSAQ

SEQ ID NO: 1141 - protein, 31 aa, Artificial
  Synthetic peptide
ARWLTPVIPALWEAETGGSRGQEMETIPANT

SEQ ID NO: 1142 - protein, 1 aa, Artificial
  Synthetic peptide
E

SEQ ID NO: 1143 - protein, 11 aa, Artificial
  Synthetic peptide
AHILITFPLPS

SEQ ID NO: 1144 - protein, 92 aa, Artificial
  Synthetic peptide
TEPKPQLGTLIFSNITPKSFNMSWTTQAGLFAKIVINVSDAHSLHESQQFTVSGDAKQAHITGLVENTGYDVSVAGTTLAGDPTRPLTAFVI

SEQ ID NO: 1145 - protein, 81 aa, Artificial
  Synthetic peptide
CEYICSSLAQAASPNPQGQRQDFSVPLRFKYTDPQPWTSRLSVTFCPRKTWADQVLTKNRRGGAASVLGGSGSTPYDGRNR

SEQ ID NO: 1146 - protein, 44 aa, Artificial
  Synthetic peptide
GKWLPGASASYSGVESIWFSPKSQEDIFFPSLCSMGTRKSQILS

SEQ ID NO: 1147 - protein, 3 aa, Artificial
  Synthetic peptide
VKS

SEQ ID NO: 1148 - protein, 4 aa, Artificial
  Synthetic peptide
HSEA

SEQ ID NO: 1149 - protein, 3 aa, Artificial
  Synthetic peptide
VKS

SEQ ID NO: 1150 - protein, 2201 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGRGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

What is claimed is:

1. An isolated polynucleotide consisting of the sequence of SEQ ID NO:1.

2. An isolated polynucleotide consisting of the sequence of SEQ ID NO:8.

3. An isolated amplicon consisting of the sequence of SEQ ID NO:957.

4. A primer pair, comprising a pair of isolated oligonucleotides to amplify the amplicon of claim 3, said pair of isolated oligonucleotides consisting of the sequences of SEQ ID NOs. 955 and 956.

5. An isolated polynucleotide comprising the polynucleotide sequence set forth in SEQ ID NO: 1 or degenerate variants thereof.

* * * * *